United States Patent 10,233,495 (METHODS AND COMPOSITIONS FOR SCREENING AND TREATING DEVELOPMENTAL DISORDERS) - sequence listing, part 60

SEQ ID NO: 517 - DNA, 76800 bp, Homo sapiens
ctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttattacacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggcct

SEQ ID NO: 518 - DNA, 81063 bp, Homo sapiens
ctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttattacacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggccttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggc

SEQ ID NO: 519 - DNA, 75953 bp, Homo sapiens
ctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttattacacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatat

SEQ ID NO: 520 - DNA, 33717 bp, Homo sapiens
ctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttattacacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctcccc

SEQ ID NO: 521 - DNA, 17979 bp, Homo sapiens
agttgctgagccattggctcatcaccaggccatttgaaagcaaatgtccccttgaggagagaaggtgctagctgatctggcctctctaaggtatggaactataaggagagtctgtgggagctgctggcctgaaataagggctggcgattgaggcgatcacggggagtcgttgaatggctggagagagctgtgtggctgggctgcccccgacctggcctaggctggaggctgagcccgcgggaaggtccggcggtgccagccgtcccaggggctgcaccgccacctgctgagcagcccgggcagtcaggggtcctgcgccgcggggcccacgcacgggaccaggggcacggccggcggcgagtgggaatgagggacgcggaagggggtgctcaggtgagcgcaggctcgttgctccctggcgctgcagcccttctcgccagggagttgaatgcccgggtaaacaccaggcgcgatgtgtgcggtgtattcacagagagacaaagccagggcggggcgggggcgccgcccgcgaagcgggggcgggggcgaggggtgcagactagtctcccccggcgcggggtgcccaccgcctgggaaccctgagcccggcccacggacaggtggagcgggggcggggcggtggctgggcgggtcccgccccgggggtggggctgggcgggccgggcggggcggggctgcgctatgcaaatgtcgcccacgggcggccaattgccggcgctccccgcgcggctctgagcgccccgtcccgccggcggccgcgagaccagagcgagcgaacgaaccgcggcggtccggagagccccgagcgcagcgcaggacctgggtacgccgcgaggaaccgtgcagcccagcgcggccgcccggcccgggtccagcagccaggagagcgcagcgcttcgaagccgagtgcgcgccaccgcccgcgccccgcgctggggaatgcgccctcggcgcgccggccagggggcgcccgcagcccaccccaggggaggcggccccgagcgcccctgagccttcccatggcccgggctggggcccgggccctcggctgctgacgcgcccgaagcccgcggaaccggttaagccgcggccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtgagtgcagcgggaaccgggagggagcgggcaggcggccgggccaccccgcgacccctctgggacccgcggcactgcaactccgcagaagtgtccggggagcgggtctcgtcgagccggggggctgcccgcggacataggggcaacaaggctggggtgggattcttacctgtcctggaggcccggaccccttacctacggggcggcgtatggatgtgtggatgatgtggcctgcggggtcacccatgtgcaaagcaactttttcctgcaaggttctgggtgggtgctctcatacacccccaccttcacgcttctggagcgggagttccgatcccccttctgcctcagctctctctcccattaacgcccgaggcagcgctcttccccgtagatgcgcttgccctacctcagtgtctctacttgaggactggccagcccgaagggaagcggtatactggcagtccccacgtggggggtctcccacatcagcagagtgggaggacctccagtcctgaggcatttctcccagcattgtgccagccccttgacccccagctgccaccttgggtttgcttttacagcagagtcctgcctggattaggggcacggctgtatgtagtgtgtaggtgagcttggagagcctgcggtcaatccctagtttgaaccaggggtcccagtggtgaagtgggcaggggacagcgggggcttggcggggttgcccccagcagatgggacaggagggtatcaaagttggcctaggaatgaggcagtgctggcgggagttggctggagctggggctgggggccccactggataaataactcctaatttttgagatagctgtgttttgccaccagaacattactgcttgggagaggtaagggagacgccaaccaaagacaccagtatgtccaccctgaagctgggccaggttggggacctctgtcctcctgaattcacccagatagtctcccagtagttatcctagttgcagagaagggaaaactgcacccaggggttgggagccccatctcagcccagggagttggatggagctgaggcctcttcccaggctacccaaggggtgtgccaggaccccgtagggtatagtgtctaggcaggcggggggcacaggcatgcctactcctgctgctcccccttcagctccgaaggagccaggcccggaagtggggaggtgggggccggagagaaagcaggggccagagagaaggcggcagcccacccagcctcagcccctcgctgctcagcataccttggggggaggatggagccaggctcaggtgaccttgactgggaaaccctggccacaaaaggggggtttcagtcccagctatgctggggtggctctgcttcctggtccttgaggtgttgggggatggggaagctgaggagccaagaaggagacagagctcttgttgaagtgggggagggaatctgaggggctgggtagcgggtggggtgctgttgataatctccccatgttcccctacggcccctgttcctgcctcccttccatccaggcagtcctcagctcggaggagccaacctcccttcctggagacaggctgtccacccccacccccaactccaagcctgggcggtctggatccggctgtacagtttggccacctggccccctgtcccatcccaggtgcctccggactccttcctctggccgcctcttccctgcaccccttgccagccccggctcctcgtttctttgttcaagcgtctctcctccgtccctccctctctcctccctctctcctcctccctcccgcctgcctccctcccttgctccctcccaccagccttccttccctccttctctgctttcttcctggtgggctcccaggtggcggtggctgttcttcctctgtccactgacctgggcttggtgtgacttgggggcttttctggggctggggctgggtgacaggcatctcgggactggcagaggggaaggcactgtgggtttgccctttctttccctctctgtccttcttctccttttcttccttccctctccttctttcccccacctgccaggctgtccaagaggggacctggacttgagactgaggccccagcaaacttgagcccctccccattcacctctttaaaaggccaaagcatttggatgggaagtccctgtagggacccagtagaaagactccccacctctctggacacattgggtgactccaaccctgtccttggtgacactgactttgtcaccatgaacatggatgaaggaaaaaatgaggtcatggggaggggggaggcgggaggcaggttgacaggagcccccgttacatagtatcgaagctctctgagggactcagacggcatcttgcgccaggacagtatctcccagctcccctgagccccaccccactagcaggtcaagttcttgagcaaactcatgcttgtaaggacgtgtgtgggcctgcaagtgtgaacgtgtgcatatccacagctgttatcaggggcctcccaggtgcaccttgagggtgacggtggctgcacagccatttctcccacctgcccccacttctcagagcctgccattcagtcagcactagctttgtgcctcccagacctgaggaggggctggttctgattcccccatcccccagctagcctccccaggaggcagcatctatgacaggggatctggaaggaccatgagcggtgtgccaggccctcgggagagaacattcacacagagggtaccgcgtaaggagtgggccaagaggctgaagctgcacttcctgtctgaggagccatgagtggtttgccttggcaggagaggccagggctgggggaggtgggtctagggatgtcatcagggtctaatgagtggggcctaagagtcagactggagcctgggctttgcctcagcattgagcagctatggcaggggagtcccaggccatagtactgccaactcccatcccagcatcctagagatgggcctggggtcctgcctgccacggaagaagggagtacacagggcagatctgggggatggggctcacattttcagtctcgatgcccccacccgcagtgcatccggttgggggtggtggtaggagttggcgctggtttgtgccgggagggagcaatatgttctgacaactggtgctgggctgcgtttacccaacagccagcctgcctggggagacaatatttgaaaaacacagtattgaaacttggacctgctggggctatgggggattctgaaggtggcaatgccgctggcccagatccagccccaggcccactggccatcctagcttcccttctttgccctctagaggcggagctggaagttttccctggcaggaagtccttctgcctgtctgacctgggtctctcctgctttgattttagtacaagtggactctgccattctctgcctttccttttctgactggtgctccctctcttccatcttgggctgtctgcatgtgtctcattcccccactctctcctgtgcctcccctctaccgtaataatcaggtccaggtttctctgtactgggagaagacctgtggctggagcaggcagggatgcaccctatctgttccccattcctccaggtgggagggagaaggagtaacccactttattggccacagatgcaggggagaaaggagaaagcatgctgggagctggaaagagccctaagatcacctggttggtctgggccctgtgaatggaattcagcatgccatgaggggtagggtttgagtctccagcagcccccatcagttctggtgaccccaggctggggcctattggtactatctccccagacaaaggcaggccaaagaacgcacatgaggtgtgcacacaggggcattcatggccccaggctgggggtggaagcgtggaggtacccatcaacctctttgttcaccttgggtagaaattgaactcccccatctgcctcacacattccaatcttggttccccttcccaggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaaggtaagaagctgttttgttcttccccagaaatcatcctctctttacaatagcgctcggctcctctgcacacgagagaaagggtgggtcaggacaaaaccaggacaaattgtacagccacataggttgtgggggagaagggagaccggggaggtggtggcttgctgggaaaggctggagaactgacccatttagacacttagcaaaagagtccagagtctgggcatcttccagagtcagactgtgggttcctgggctgggtggcctgaggtctgtagggcatgtctttctgtatgataattggagaggtggcaatgtcactccttccaaacttatgtctgctgcggcccctccttgccactgctatgcatctggtcctgccctgagcagcccctggggtggaaggtcaggcagttgggcagacactggaacctctggacactggaagagcaggacctgctctcttggggtgtgggtgctcgaggagccttcctatggtctccaagtgggaagggttcctagaatccaggaggggactgttggctgtgactggcagggaggccgccggtgggttcaggcagagcacgtgctgctgtgagggcctgagctcctgagctccagtgagcactttgatgagaagtcactgggaggtttcagtgatgggctggggtctgcagagtgagaggctggtcgcccgctccatcaccattgcacttaacccactggacaggtgcacgcacacggtacacacatgggtgtacaaatggctcactcgagagccacttcctcaagggtgtgtgtggtctgaagagtctcccctgggcccagggtgaggggcagtggccatgctggggcctgggggacctggggtcattgggagttctcagccttggccctcctctggccagaggtaacttcatccagccgcctgccctgggtggggtcgactcagccctggctggccagatttccgggcagccatactggggtgaaaggctggggtgacctttccttcctcgggcttggcggaggcccagccctcacctcaccatgtcccccagcagggcccctcccctggcctcgtcccaccctgccccttgatgggaggagtaggggagtaagctgcttatcatcactcttcccagtcacccggctcctggaatttctgaggctgtgcctggaaggagtcccctgcagggcctgagaaatgggctgagaagagttaatttgtttgggctggaaagcaccccccttccccgggccccaggaaggtgagatatttattctgctgatacctccacccttccctggtggaattcttcagagcagattaataaatcttgaaggggccagttcccccaaacccctccccagcccagggtctggcagcgagagtagagtgtctcctcccccgatagtggaagggaggggtggcttggtctccacacccctgggaccttgcgtccgctctgggtgttgtttttgtcatcatgcatgcaagtaagcaggaggggcaaaacagagaggggtcttccgtgtgctccttctaagcctccctggacctccaggggcaaagagttttgttcctgttttccagagagagaaactgaggctcaggcaagggcagggtcaaggtcaggcaagaggcagaggcaaagccagaaatagaaccctggtgtcctggccttgccggcgcccacatcgcgtcaggtcgattccctctcaattagctctgaagccgacacccgcagtgactaaaagctgagctcactggcagccagcctgggtgttgccggttgtggcggcctggggtggggctgcagcgcacctggggccacccatcccagggctcctgtgcctttgcacaggcaggttcccctgccctgaatgaccttccctgttccgacctggtctcgtgtcctaattttgtgcttagacttcacttactactgtatgacaggccccgtgctgagtgctggggactctgtggtgaacaagatagggtgctcacagtcaagctggtggaaaaagcaatggatatccagttggtcagggccatctgggagcccagcacctgctgtgtaccaggccctgtgtatccccctacactgggtggtctcagcctggttatgcacacatgaagtggccctcagtgaggagcaggcgcccaccaagtgtgtgtggagtgagaatggagaccaacacttcaagaaactgggctcccaccatcttcctcccagagtacacgtgggtggcacagagaaggttactctcagaagcactgctggtcactgtggctccatgtcatagttttttcatctgtgccttggatggacacagcagttgacaccccaggcctcaggggctcaggctgggcactccctgccctgccctgccctgggtcctgctgtagtggggaggtgccggttcctgcctgggtagggctggaccctccaagctagaggtgctggcataaggggccacactgcccagggtagataaaggaacaaaggcaggaactgggccaggcttgggtttgctgcccgcccatccgcctgggcaccccagccaggtctagagccagaagggtgtgagggtcaagcagcccagggttccctcagattaggggggctcctatggcccagcttctgggcttcagcagcacagccaaaatcaggcagaagtgagggtcaaatggagatttccaggagcaggtgaggtgtttgttcattccttgctcttgagagagtggagcctgggctggaagcctggacagaccctccttccttcacccatccatgcctgggcctggagtcccctacactgcagaatcactgccaaatctcagagaaaaagctcttccttcccccaccttgagatgacccaggctctggggcaccacctccctccgtggcagcagcagggaggtgtgagggccctgccaggccctttgttcagcctggggagtgtttactttttcccaggaagctaccccacgacacactgctgctgcctgggctgggtttggccagggattggggccaagagatgtttggtggggtagaaggaccctgtgatgacatgagacagttgtgctgctagggaagctgaggcagaagtagggagagggagcagaaggtcaccctgccaggggaggtcaggaaagatgaacataatcgaaatagtagtaggagcccatgaggataaccaagcaatggtccctccaagacctaaagagggtctgcctaggtttcctgtgaggaaggaggcttacgggggctgagcggcttcccaggtcactcaggagcaggactgagatggagcctgcatccgcctgatgcctgaggctgtcccaggactgagagtggagggcagggatggtggtggtgctggaggcacagacccttcacatgagctaggaacaaggaagattccagcattctgcagtgctggtttaggcttcctagcctcgtttcccaaagaaagggctggggtcgcactgggcaggctccccatgccctctgtctgccgaagcaacggaattggggtttgcttatttccaggctataaatccggccctccatcactctggcccttccactgagcagggtccctaggaaggcctctcatgtcagagatgggaacatcagggcctaagagaggaaagggctcctgttccagagcagcctggagtttgagccctccaggccaatagcccagaacagtgccaccgctcacatcatttgcatgtggcatcagaggaccaaggttgccaggtttggagatgatgaggttagaggttaggaagggtcacagcccgttgacttcccctcaggagttgatgtgagttgaggtgcctctagcaagccttgatggggccttagccctcaggcctggtgcaggagtaggggtggggctggagagctagaggacatgctcttgccccccaggggctccttggccagccagagcaaggcatggggctttggtgggggaggagggggaggaggcccaggagctttgaggccagtgtggcaccagggagctgggcaagggtcaggtggctctggcagctacagtgggggttggagctcacaagccagggagggtaggtgttccaggatacgccaggatgagggaggaaggaagacccaaagcatgaacttgagcccagatcccttgaggccagatctggagtttcagttttctggaaatgggagctgccttactcctgagagacttggaagtggccgctttggagttgggaggtcctggaagctgcacatcccccaactggctaggaattggtctttggagagaatggagacagggtccttgtgcttgctggagaacctgcctgacgcccagcctgggtcagccaggccaggggctggggctttcagctgtggccttccaggtcaagtggagcttcagatgggacctccactgtctgggcctccgcagcacaggccttgtctctggttccctggcatgatgcccgcccctccttccctggctccagcttcccttggcactaagtgaggagctggtgcatgctcaaggagtaaatcatgttccttggcagcccccactgcttcgtaatcgtaaagaatttaaagagaaaccgccaagataaaaatctcaccagcccataaaggcatctttcaccctgcagcttgggagacagtgagcctcagagtgggctcttggctgtctgcacctgtgtgtatgcacctccggccccttgactcctccagaggtggtaatagctcagaaggtggctttagggccatgggtacctggtccttgactcctgggagacctccatctcctcactcaggagagtggggtgcttaaatttggtgtaatgcagaagtggtgatggtggtggctgagctagctggtcccaaaggcaaaacccagttctaccagtgttagctgtgtgagttcagccaagtggcttagcctctctgagccctggtttctcctgtgtaaggtgggaatggcagtggccctgtggaagcagcatcatgagggctcagactgtcttgcttgcatcctggccatgggtggatcttgcttggtgaacatcattctgtgttcccactgccttttctggaaaatgggagtaagaacaatactggcctcgttgtgttgtcaggaggattaactgtgtgagtatggtcactgtggaagaaatctcagtcaccaggagcgatcctgaggctggtgtgcaggtgagggcaggtccaggggcatgccccaaggagtcccagactgcctcaccccttcctccagaattctaacttttggtaagggagatggtatttggaaaggactccaggaaggaccctgagtcctgtggggtgggtggagtagggtcaggaggaggaaaattcctaccatgggtatctgggcaggcttcatggaggaggctgcatcttgagcaggggaggggaggttgtaggggagggaagagctggagcacagggagggtgcatgtggtgcagcacctggggaagaggacagatgctagatgcagtcttgcttttgggacaaggatgtagagttctactttctgtttctggtttttaagctctttttcctcatggcagaggtactaaatatgtattatggaaaaattccagtgatacggatgcatttggcgggagtgatgccttggaagtagctccctagagactggctccaaggcctggttgggacgcacagttggctgcaataactccttctgtgaatgctgctccagctcctgccgtgtgtcctaggggtgaccagacctgggctgctcactcaggcatctgcagggctgggcagaaagcatgtttgcctggcttggcctggtgctatcctgggaatctgagccccgcctcaagaagccctgggagctttggagaagcagagaggattcctgctgcatttttcttagaaatagcaagagggcctttgccagaggcctggatgccagaaggctatggtctgaatccaaagcctagctcacgtgggtgccagagcttggcaggcctacagccccccacccagcctgctgggcagccccagggagagggtggaggcctcctgggctccagtccctgaccactggtcctgacccagcaacgaatggggtctgggcagtggctgctggcctaggattggggggctagcctgttggggagggagtggggctcatcgggctgacgggctgggctgacttctggcactctcactgggccgaggggagcactggctatctggtgcatctctgcagggcaaagacagacccaaagcaaccggcccctccagggatcaggaagcctcagctccggatcccccttcccccactcttcttccttccttcctccccctactcccccttgcctccacccctccctttgccacccctcttggcttcctacccggacatgctctttcctcggacgtctctgtacccagccaagagccttgttccttcccacttggggctcggtgctgatgccctcatttcccccggccagagtccactgcctcgtgtgtctgctgttcagccagcacggttgccttctaagggtcatacactacaattggcagagcggctagaatttgggagccctttgggctcctacagctccaaggctgagtggctagcactccagggggcctctcccagggctgcctgtattgccatttttatcagcgccttcctggctgggcctggggcctgtgcggagtgctcactgcctgcccttgactggctacctgctgagtcctgctgaggtcctaacccagcctcactgcatcctccaaggctgaccccaagcatgcacctgtctgccctgtgcctcggtttctccatcagaatgttggggaggggctaagactgtctggaacatcccgggaatctctgggtgggtgttgtgaaggggctgcagggaccgcaggaatccgaggaaggccgcagagatgggggctgggcccaggggagggggagggttttgacacccaccagcctgttggtcccatcttggcctgtctgtctgggtgatttatcagagtaaatgagccatggagagtttgttgtcttttgcagtcatggggaggaggaggtggtggaggaaggagtgaggggtttccgggccaggtctggaatgtgggaggaggaggtgggtcccccgggggcctctgaaactggaggcactcactgaatggccttttcactctccccacctgagaaatgaatcagtgcagccctccccttcagaacaatcccctctttccatccccttcatacttcttggggcacattcctgtgtgatctgcttgtctggtcatcttctcccaccccctgctcaggaccaggtctcttgaccacagtgtccttccaaagctgagccggagccctgacttgcccagctggtgaatgcccaaatgtgttctcacaggcaaccatgcacactgttaagttccaagtgggacgtctaggcctctggaactaccagcccaggcctaggatggtcaggtgcatggaccatggggaaggcaggggtcagtggaggtgccgaggccggagagaccccatctgctgggacagaaggtccgaagtcattgggtgtccttcggggatgaggcatggatcccctggttcccggctggcgagtcagggagtgatcctgctgctccgtcacttctggcttttcctggtttgaggctgagctgtgccctcagcctatcctgtcctgggcggagtaggtgagcactggggcggaacgggcgtgggaacagcatgcctggacctgctggccccagccccctgccccctgcccccagcctttagtcactgaaatgggagggaagtgtacagtggcgttttggcccagctgggctctttacccctgtacggtgtttactgaacagctgggatgtttacagtagcccttgcaaaggggcccctcgttgcaggggatttcccatcttgagggtcccactggggctcttctgacctcaccaattccctgcacccctgggatagatgtgtcagggatacagagaccataaccatctccaccttaccagagccagtggtgcctgtccccttggcctctggccttcggttcctctgctctggaggagccaacatttcccaccacatttcctagagtggcagctctaggtggtgaaatacggtaactgggtccccagttcagacatttaaattaaattcaatcagagcggttattgaataaaaacacgcggagtcatttacatgttaattatgttgaatggactactagaccataattagttgctaattgggtgagagtggctgtaattggttttgttggcaccaacctggctcacctacctggggggaagcgggggttggtgtggatggctcctagggaggccctctgggtctccaatctggaaggcctggctagagatgctatgcgggggcagatctccaggggcttagggtcagaggaacctggaacctctccccagggagggtgcagctggggtctggcttctagggttcccatccagagcatagggggaaaagggggaactggaggagctaccccagatcagcagtgatagtctcccctgcccagccccatgtgggacctgggcttgaacaaatggtaagtgcccaagagtgggtctgtgggagcccaaggcaggcgtcactcaggtgtgtctctgcacatactgggccctgggttggcctgatcagggtggcgttggggtgtaagtgggtgtgccaagcaggaggaaggtacgtacaaaggcatctgggcctccctgcccccccgcttagcttggctggggttcccggggttgtaggtctgtggccatgggctgaggccttccggctggccgctcattaaaagaggattaggctgagagccagggggccagcccagtccccaggccttcctctggggctcctcacagctttgggggagtgataaaagggccggggccaccccttcctggatcctgtgggggtatccggtagggaccacctgggccctgccatgcctcttgccgccactgctactatagccttggctacctcagtttccctcctcagaaggtcaggaggtctgtctttccggtgggtgaaacactgacaaagacccaggctggtgcctccccttgtcccccagtcccatctctcttcagctcagggattagggctgcactggctcactagaggtcagaggtctgagctaggctgcagggatctgtctatcatccccagtccccatcactgctgggggaggtgacgctgtcagtcagggcctgctgctttgtggggctataaccaagggggcgggctgcccacctctgctccaagactcctctttttgcggcagcccacacctcactgcacgcagacctgatgtcctggagaccagcagcaaggggtaggggctgcccacttggggtcttcgggtgagggctgtggacacgcctcctcagtgcctgtcctcacctgcccgcacctttaaagtaaggtatcaccagctgcttcccagatatgagggaccgggggcccccaggacccagccccgtgtgccttgagaaggtcctgcctctggacctgtgccaggccgctttgggctgggaccccaagtgcttgatggccatgagagagtcctggaggccaggaatggctgcggaaatgaggtgtctgatgccagaaaaggctcttccttcccgatgatgggaaaatccttcccggatgtcacccctcccaacctgtgcccagcctgggtgagagtatgggggtggggagcccttcccaggagacagcacccaggcacaccacccttcctccccctaaggtcaaagcttatctgggctggagtcctgatccccacagaacccttgattgtgcccagcccctccctcaacattgccatggcattcgaggaggcatggcgctcctgctgccagagccgggcgtgggacaagtggagcagatgtggggattggccttaggacatgaccaggctgggtctgcatcagccctggcccccactgatgccacctcaggtcccaggttcctttgttccttctgtcccaagtccctgtcccttaagggagctggggcctggtaggatctggcacctgctgatggcaggttttggaggaggatacccagggctacttgcccaccccctgctctgactcaggctgcttggaggagtgaaggctcccagttcctttgcctcatggtggagtggggagcaggggacaggacaccctgtgacctgggttgagtaccactctcctttgggcctcagtcttcctgtctgcagctgggggtgcagggctgtcacagggctccttgtttcccttttcacctacagtctggcatgagtggggtcagaagtccagctgtgggttgagaaggctggaaccttacaccttctttgctctgggacccggggaagttcccacccctctccaccttggttcccctctggtaggctgggtttggatgaatggtttgggatttagctctattcctgtgggttggggatggggtaaggacacactggagttgggaaggctggagctgagtccacaggttgcctcttcctgccttatagccctctctgctccccaatctagcactaggaaatggagtagctggggtgggaatggggatggatgccctacaagagatagcgacacgtggaagcctgcttccttggggaaggacttgggacctcattccactctcctttccctgaaaggcagagacacccatgaaggatgggttgggggaagacctgaggaatgccaggccgtgagcctctctctgagatcagaacggggtcactgatcctcagggtcactttgaatatcagtaccaggagggcctgagagatggtctagactagagaatgaggctcagagagcgagagtgcccccaactcaggtcatgaagctcacccagaaactcaagccatagccaaggatccctgatcctgggtcccaccccttccccaccatgcgcgacctcctggggctccccctccccccacactgtttccacagtgaccaaagcgtcacgtcctgtgacaccagagccattgacgccatatcccgtggccactgggaggggtcccgcaggtcctgagtcatgtgccctgtccacggggagcgagtcaccttccggccctggccctcctggcaggcagtctctaccaccaggactggcttcccctgggcctccccctccttcagccatggacctaggtgggaatcccacccccatgcactctggcatgtcacatcccttccctgtgccctgtgcccttggtattgtgagcacagggctttgtgcacagcgggtgttcgataactgagcaaggggctccctccacccccacctccacccaggggcagactgggggcagcaggcagagagggtcgaggccaatcctctgcccctaagctgggactcagtttcctcatcctctgagtgttctctacggcctttctcacagagggagctggagtttgggagtgctggggctttgcaagagggtaggggactcggacttgggcctcgggctctgggagtcttggtgcagggttgatattatagaggcccaaggctgcgcagggttggagcttggggattatggctgattgggttcctgggggcttaatggctgaagcttccccttacccggagtgcccgtgtctgaaggcgcccacttaagcctctagcccctccccctgccattgcccccaaagtgccccctagcccaggggatgggtaagggcatgaccgagccatgcccccagccagggtataaataacccctggcgggctgtcccagcctgggggggctccactggcagccccacttcctctctggccacttcccagccctgggggtgggggaatgtttactttcctgttgtcactgtgggtgagcagccaggcgggtgagcggccaggcgggggactccgagtggcccaacaacaggtgcgggacaggtgcctgggccgccctgcccaggacttcagaggcgccgctggacaggcgggtgaggccatcgccaggcaggatcggccctttgatccctcggcgtccctgcgtcccagcggttggccaaggtcatcacctgcattcccttgtcaccgcatagtcagggccaggcagggcaagacctttccttacccactagtttctcagagtgaggtcctgggaccagacatgggctctgggtcagctggtggaaccccctgaccccagcccacctctgccccaccttcaggctgtgtctagggcctcggatcccagctgttctccccctccaggtgccttggggcctggcccaggcctctcccttgactgccccacctgtgaaatgggttaccagctggggaggggagatgagacatgtgtgacccccttggtgagtgcctcatgtgtggtaggacatgtgtgcgccatgtgcatgcctgtgccacgtgtatacatgcatgcactcttctgtgtgctgct

SEQ ID NO: 522 - DNA, 1716 bp, Homo sapiens
catcaacctctttgttcaccttgggtagaaattgaactcccccatctgcctcacacattccaatcttggttccccttcccaggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaaggtaagaagctgttttgttcttccccagaaatcatcctctctttacaatagcgctcggctcctctgcacacgagagaaagggtgggtcaggacaaaaccaggacaaattgtacagccacataggttgtgggggagaagggagaccggggaggtggtggcttgctgggaaaggctggagaactgacccatttagacacttagcaaaagagtccagagtctgggcatcttccagagtcagactgtgggttcctgggctgggtggcctgaggtctgtagggcatgtctttctgtatgataattggagaggtggcaatgtcactccttccaaacttatgtctgctgcggcccctccttgccactgctatgcatctggtcctgccctgagcagcccctggggtggaaggtcaggcagttgggcagacactggaacctctggacactggaagagcaggacctgctctcttggggtgtgggtgctcgaggagccttcctatggtctccaagtgggaagggttcctagaatccaggaggggactgttggctgtgactggcagggaggccgccggtgggttcaggcagagcacgtgctgctgtgagggcctgagctcctgagctccagtgagcactttgatgagaagtcactgggaggtttcagtgatgggctggggtctgcagagtgagaggctggtcgcccgctccatcaccattgcacttaacccactggacaggtgcacgcacacggtacacacatgggtgtacaaatggctcactcgagagccacttcctcaagggtgtgtgtggtctgaagagtctcccctgggcccagggtgaggggcagtggccatgctggggcctgggggacctggggtcattgggagttctcagccttggccctcctctggccagaggtaacttcatccagccgcctgccctgggtggggtcgactcagccctggctggccagatttccgggcagccatactggggtgaaaggctggggtgacctttccttcctcgggcttggcggaggcccagccctcacctcaccatgtcccccagcagggcccctcccctggcctcgtcccaccctgccccttgatgggaggagtaggggagtaagctgcttatcatcactcttcccagtcacccggctcctggaatttctgaggctgtgcctggaaggagtcccctgcagggcctgagaaatgggctgagaagagttaatttgtttgggctggaaagcaccccccttccccgggccccaggaaggtgagatatttattctgctgatacctccacccttccctggtggaattcttcagagcagattaataaatcttgaaggggccagttcccccaaacccctccccagcccagggtctggcagcgagagtagagtgtctcctcccccgatagtggaagggaggggtggcttggtctccacacccctgggaccttgcgtccgctctgggtgt

SEQ ID NO: 523 - DNA, 2412 bp, Homo sapiens
catcaacctctttgttcaccttgggtagaaattgaactcccccatctgcctcacacattccaatcttggttccccttcccaggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaaggtaagaagctgttttgttcttccccagaaatcatcctctctttacaatagcgctcggctcctctgcacacgagagaaagggtgggtcaggacaaaaccaggacaaattgtacagccacataggttgtgggggagaagggagaccggggaggtggtggcttgctgggaaaggctggagaactgacccatttagacacttagcaaaagagtccagagtctgggcatcttccagagtcagactgtgggttcctgggctgggtggcctgaggtctgtagggcatgtctttctgtatgataattggagaggtggcaatgtcactccttccaaacttatgtctgctgcggcccctccttgccactgctatgcatctggtcctgccctgagcagcccctggggtggaaggtcaggcagttgggcagacactggaacctctggacactggaagagcaggacctgctctcttggggtgtgggtgctcgaggagccttcctatggtctccaagtgggaagggttcctagaatccaggaggggactgttggctgtgactggcagggaggccgccggtgggttcaggcagagcacgtgctgctgtgagggcctgagctcctgagctccagtgagcactttgatgagaagtcactgggaggtttcagtgatgggctggggtctgcagagtgagaggctggtcgcccgctccatcaccattgcacttaacccactggacaggtgcacgcacacggtacacacatgggtgtacaaatggctcactcgagagccacttcctcaagggtgtgtgtggtctgaagagtctcccctgggcccagggtgaggggcagtggccatgctggggcctgggggacctggggtcattgggagttctcagccttggccctcctctggccagaggtaacttcatccagccgcctgccctgggtggggtcgactcagccctggctggccagatttccgggcagccatactggggtgaaaggctggggtgacctttccttcctcgggcttggcggaggcccagccctcacctcaccatgtcccccagcagggcccctcccctggcctcgtcccaccctgccccttgatgggaggagtaggggagtaagctgcttatcatcactcttcccagtcacccggctcctggaatttctgaggctgtgcctggaaggagtcccctgcagggcctgagaaatgggctgagaagagttaatttgtttgggctggaaagcaccccccttccccgggccccaggaaggtgagatatttattctgctgatacctccacccttccctggtggaattcttcagagcagattaataaatcttgaaggggccagttcccccaaacccctccccagcccagggtctggcagcgagagtagagtgtctcctcccccgatagtggaagggaggggtggcttggtctccacacccctgggaccttgcgtccgctctgggtgttgtttttgtcatcatgcatgcaagtaagcaggaggggcaaaacagagaggggtcttccgtgtgctccttctaagcctccctggacctccaggggcaaagagttttgttcctgttttccagagagagaaactgaggctcaggcaagggcagggtcaaggtcaggcaagaggcagaggcaaagccagaaatagaaccctggtgtcctggccttgccggcgcccacatcgcgtcaggtcgattccctctcaattagctctgaagccgacacccgcagtgactaaaagctgagctcactggcagccagcctgggtgttgccggttgtggcggcctggggtggggctgcagcgcacctggggccacccatcccagggctcctgtgcctttgcacaggcaggttcccctgccctgaatgaccttccctgttccgacctggtctcgtgtcctaattttgtgcttagacttcacttactactgtatgacaggccccgtgctgagtgctggggactctgtggtgaacaagatagggtgctcacagtcaagctggtggaaaaagcaatggatatccagttggtcagggccatctgggagcccagcacctgctgtgtaccaggccctgtgtatccccctacactgggtggtctcagcctggttatgcacacatgaagtggccctcagtgaggagcaggcgcccacca

SEQ ID NO: 524 - DNA, 697 bp, Homo sapiens
ttgtttttgtcatcatgcatgcaagtaagcaggaggggcaaaacagagaggggtcttccgtgtgctccttctaagcctccctggacctccaggggcaaagagttttgttcctgttttccagagagagaaactgaggctcaggcaagggcagggtcaaggtcaggcaagaggcagaggcaaagccagaaatagaaccctggtgtcctggccttgccggcgcccacatcgcgtcaggtcgattccctctcaattagctctgaagccgacacccgcagtgactaaaagctgagctcactggcagccagcctgggtgttgccggttgtggcggcctggggtggggctgcagcgcacctggggccacccatcccagggctcctgtgcctttgcacaggcaggttcccctgccctgaatgaccttccctgttccgacctggtctcgtgtcctaattttgtgcttagacttcacttactactgtatgacaggccccgtgctgagtgctggggactctgtggtgaacaagatagggtgctcacagtcaagctggtggaaaaagcaatggatatccagttggtcagggccatctgggagcccagcacctgctgtgtaccaggccctgtgtatccccctacactgggtggtctcagcctggttatgcacacatgaagtggccctcagtgaggagcaggcgcccacca

SEQ ID NO: 525 - DNA, 112750 bp, Homo sapiens
ctgtatatacgtaggaaaacattcttttttgtcaacttgacgttgacaaacttggtggatgtcaggagtaagggtattcaagagaattttgaagaagaatttaatatagtgagtatcgaagacaactcttaaagagtcttgcgttcaaggggttgtgagaaatgggttgttaatggagggcaatgtagtatcaaaaagctgtttaagattgatgatatagcaggtttgtatgctaatcagactgattcagtagagagaaaaaacataatgccggaaagagagggatattgctgaagccatagacctggtatacaaatagaagggttcgttttaaagataggcacacaaacagctcattagtaacggtaggatgaagggcagattatggagttctagatgtcggtagttcagtaaataggagcatgtcaaatttttgttatattttctcagagaaataggaaacaaggtcataaagagggaggaagtcatgaaggattaaggaaggaaaaggagatgtaaaatgggtatccaggaatgtaggaaagtaaacatactcttaggcaatctgtggtttatttaagtggtatcagtcaatgtggttttgtgtttttctccagttgagttcagcataggtgctatcactgaaaaagtacagaattcaatttaactaaagttgagatttccctaggtgaataagacagtgatgagatgttgttacatttaagagaaagataataaaagagagatatggaaagtaatctgggttaaggagtgaagtgagaaaataaagaaggttgagacagtggaaaatggtatcatcaattgtagattgcagtgtggttgaagatgcattggagttcttgaggtacaaactagaaatttgggagatttaaataagagtggggtggctgaaattgaaattagagtataataatatataatagtactaagtatagtatactaagtatagtataatagtactaagtatagtatactaagtatagtataatagtactaagtatatagtacttagtgattataagttttaggatgtgaggatgggagtagcatagaggcaaggtgatggaaggagatgaattcaagaaattgggaacctaggagattgaaagcattatctaaatgaattttgaaatctcaacaagaactgtgctgagtgctttttgtaattattttatctttactaccctgtgagaagacagcacttccttttgtgagtaatggaaagctctttaatgtgtcaactgtaagatactttattacatttaattatctttagtaattcatgctaacaaataatgacctcagtaggattattcagtagatatgtgagctaaccccctgtgtcagacacctaagagatacaactgatgattttcaagaagaatagagttctcatcccaagtacttaagctgcaaaatgtcccaccctatattttctgaaaacaaacggtatatagagcgtccatttaaaagctaataggaaatcttaaagcgtgcgcgcgcgcacacacacacacacacacacatacatacatacatacatacacacaaaacattgaataagcatcaggaaatatataccctgtacccaacatgcacaaggtctaagcaatgaagaaaaagccaggatatcaagtaagactggaacatctgtgactaatatataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatgattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaacaatagccaagtgtgtttcttttcttacatatacagtaatacttatatttcattaatttttagtaaaagctctaattagtaatcaacttgtaaaattcacaaaaaaaccaatagtattaaaatcccacttaattgttgaataagtgtaagataataatagtcagcaagttgttatgctttagaagactgactttaacctatttaagctatgaactcagaaaagcatctcaaccaatatgtttgttgccattagcatcatttaccgagctgtgtacctttaatttctgccattctataatccttccaaggagtgtttttatcagttagttagggatagctggtttaatgctgattcccatgcaaagttagcccggttgtatgctttttataatatgcaagtacttctggtgttaataaggttaaaaaatagaagaaacctaaattatacaatctacagttatcagttctattgagctcactggaatcttctcctactttatagacttccttctttttcatttttttcctaattgcttagacttgttgtatatgactttttgttctttttcttattctacaatctggatatttatttagggctttcatgacaccttgtagtctgggttttcttcccaattctctacctattcattcttcttcatcttgactttacatatggaattcattagggctctcatctaggtttccttataactctcagttgttttgtttatgcttaaatgagaacatagaggccataactcagaaactgtctattcttcacctataaattgtccctgccacaaagcagattcactgtgcattggtaccacttcggctcactgcatcttgggctgcagtttctactacttaagattgagtccagtgatttagaacatacacacaaaaagttgcatgaagcaggcttattgcttatagataggcatcaagtgacacagaagcccggcgttcaggaggagccagcctcccaagactcagaccgtttgcccagggtgttgaagactcatttgcacatgccctatttgtaccacagctgagggacccttgaaagaagcctgccccgtgttttataacccaggcatcccatgatacactgggctaaagcacttaaggaaatgttctaagaggcacagtaagagagtctgagacttatctcaggatgttgcattcccagctcattctacagctattcttgagatgcacaagttatagaggaggaaaacctgggttgctccaaggccacttggagagttgtcctgcatttcctctagcattttccttttttttctcctattacaataaagaaagtacatgtcattctaagaaaggccattttctctgcttaagttaatgataccattccatttttatcttttggaggactttagattatcctccctcttttgatttagcagtctttccctttcttctgcattagtcatcctagattacatgtattacagtcttccaattaaaaacatcaatgaccatcctcagatattcttctgggtatattactttgctcatttccttgctccctctcctaattaaacatctctttttatcacactgtctccacatcctcagcctccgtcattattcatctctctactgtccagttttcaccattatcacttcattcagtctgctcttgtcaacatcatgagtgacatttatgttaccagtccaatatatttctctgtcctcaccttaaaccacttcatagcagtattaatgatggtgggtcactttctctttctatcttccttttttcgtgttattctactctcctggttgccttctgtctcattgattgctctgtttcaggtttttgtttttttttttatcttattcttaggtggatcatcttattctgttccacctaagtcctaacttttatctatttctcttctttatcttctcttctctaggtgattggaatcatttccatggattttaaacaaatattttctgtggacacctaggtatcttcaattcagaacttggacttcagcctcatacttccatcagatgcttgttatcaccacttccatgttccacagacatctcataattaacatatttaaaatggaaccctcattttttttccttgcataaaccttttactacattattttcttactgcttagaaacccaggatattttctgatttatctctcttagctcaacaactttatctcttcatataaaccttagcatgaactattaattgtatcttcaaaatatctcttcatttattgcacttcttttgtatcttctatcacccctttatccagctcacaattatctgttctctgcattccaaaacaactctgcaactggtctcctatttccattattttactgtctccctttattttactaaagaccacaacattatattcatacaatttaaatccaattaaaatgttaatgcttaaaactcttaaatttttattgcattcagaataattctaaccactcatggtagcctacaaaatcacaccttatcagacatgaacctcagttctattcttttcccttgacaatcccatagccttaggtattctggtctttcgtcattttattaaatatgccatgtatttttattttatgttgtggactttttgtatgtgtttctccactcttttggaatcctcttaactgagttcttagcatggttggctcctgtttttataagtactcccaaacacaggaactagcattaccattttttcagtcctgcagttcagaaatctggggcttacgtttgaaaccctcttctcttacatttcccagaacaaataaagcactgaatactttagatttttgcattctatttcttcactatattattttctctttctacttctactatctagtaacccttttcttcaatgaccaaaatctattttacttccagcaatatggtgaaaagactatcgactcttaatttaaagccagactttattgtttataacaaatgcattgcagaatgtaaacagagaatgtaatcacaagccaggggctgggagcacttcatattagtttcttaacatgtcagaaccacattctttcatttttataagagagtaaccagagagccactttaagaatttttagtggttagcagaggagtagaggagagtgcccttgatacacaggtagtggtgaacatgtatctttacccccagcaggagagaaaagataaacattagagacataagctagcaagcttcaaaaaggatatttgaaaggggttttgtaatgggatatcagtttttgtacaagggaatttatttgtacaagaggttacggagcttttctcggagaataaaacaagcctgtctattacttgaaattttaacttttagaatagcttacgtgcacttatgctgattattgaggggttgactgcagcatcagcgtccacttcagtcctttctccaaccattccattatctaccatgcgatcagagtgatcttttcaaatcagataaccaccaccacttaccttaggataaaaagccaaaattcttatcagggcttgtaaccctgtgcttgaagtcttacctcactcaattctcctctttaatttctgatctctaaccatgctaatcttttagttactgcaactcaacaagatctttttagttctttaatttcaattcaagagacattctgctctttctgcttggaatgctcttttcttacctcttctcctaattaactcctgttcatcattcaaatcttaattcaaatgctgatcctgcatgaatatttattcagtattaggtcaagtcccctgatgactgttagcaatctctgtacttcttatcactcagcatagtactgtgggaaatatctgcattgttctttattgaatccttagtctcaggacattatccagaatgtcttacgaagagatcaataattatttgtaaaatgaattgagataataataaaagagaaaaataagagaaaaaatgtatctatttttgagaaggagaacatttttaatgaagatgtggccctggaatacagatgtttctctcatttttttcctatttcttcccaaatttaattaatttctggttaaccctgatttctcagatcataaaaatcatggggaaatcaactactttggcaataacccatcatgttttcaggatttgtaagccataacaacagtaaattctttggtgagctatactctcagtaagtaaatgaagaataattcaaatattattgggaaaatgatgccacattcatctgaatataataaatgtgaaattcattttactatgttcttagaactttgtaatactaatttataatagcagtttcatcctttagatatttcattttatctacggatctaattcttcctgtgaaattactgagctatttctctattcttagaagagaaaataactctttgtgataaaaatcattactatgtataattagacttccgtttacaagtcaaactgaaccaacgaacttacaatcatagaatgtgactagtcacagggaatggttggggcattagctcagtacctgtccaaagtgagctcattattatgattattagtatcaccattatcaatcagcttccacataaagtgtacctaaatgctagatctatatgatagcttccaaaatgacactgatttttaataatccaaatctttaaagagatcactttccattttagaaaaatgagatttttttttttttggaaaagatagaaaaacctctaagcattttaaccaagggttttagaacactttatttttatgaatatatcaaagcaaattccttctttattttgaaagtgactggaaacaatttcacggtcttactaagggctagtttaagtgagtctcaatttttcttctgttttgtttgctcttacaactttcctcacacacacacacacacaaagggagatataaaaaaatctagatataacagatgcaacttacaattttttggtaagaaatcataaagttttagaaaaaatcatttaggagtgtcaataaaaacgatatttaagaaaacagtaggaaaagtgatatattaaaagacttttaaacacctttcacaagaaattgaacagatgtgcaaatacacattatacgttatctatttgctcattttatcctgtccttaaacataaactttgaagataaaagaaagaagtgtggctcagggtcactcatgtaatctgtttttaggcagaaacaggtgtgttgaaaggtttttaggtaaaacaaccaccacttagacttcaataaagtagtatttattattttcctataattgcaaatttaccaaatgtaactcactattttttctttaatattttcaaagatatttttgagtaattattatattttcacaatcaattcagtagacatttttgaaaaacttatctgaacctagttttctcatctgtgaaatggaaacaatatatactctctcagtttgttgtgtcaaatgagaaaccatatatgatatactaaccactggttctggctaaatgcatacctcctcatcttttcagtaaagacatgactgttggccaggcacggtggctcacgcctgtcataccagcattttgggaggctgaggcgggcgaatcacttgatgtcaggagttcaagaccagccggaccaacatggcaataccccatctctgctaaaaatactaaaattagccgggagtggtggtgcatgctggtagtcccagtcccagctactcgggaggctgaggcaggagaatggcttgaatggcgctgggagattgcagtgagccaagatcatgccactgcactccagccttggcaacagagtaagactccatcccaaaaaaaaaaaaaaaaaaaaaaaagtaactgttattctcagtactttgggccagcacagtactgatactctcctaaaatctaactcaaagagaaaaatcacaaagcattggaattggagcagaaagtaatgtattcttgtttgacatctttccacattcagtctgtgtactgttagctgaaagctagttgacacaaaatgctgtcttaactttagtgttgtttctaatttagttctaggtcataaaatttgtaggaaagtctaattccaaaactttatcaacagctttgttacgctcaggtattatgatcagatatcttatgtgtgctctatgacctcaagcaaagattaaataaatctgtacattacagtgaagacccacatcaaccaatgcaacatacatttatttttcgcagcactcttttaggtgctttgaaacatgtaacccatgtttaagtgcagaggatagctggcaaggcaaaatataactatatgatgtgttaataagaatacagaggaatagttaaagtgatgcataataaagtacggaaatatgttgtttgatttcaaaggaaggggatagtacatatgctgaaatggcctgggaaagcttaatgataaggaaggtcttgagatgggtaagagagatttgtaaggaagagaaaggagggaaatttattccaaaagaagaaaaagtatgacaaaagcacaaaggaataaatgagatgaatggcagaaaatagatcagttaatcagtgaggctagagaagcacgtttatggaacactagtgaaaaatatgatgaaaaggtagaatgtgaccaataacagaaggatccattttctatcaagactttcttattagatttgatatgttcataccagcaatgtcatctctgaatataaaagatatctgtacttacgcaacataattatatgttatcactgggaaattctaggaagtaattatcagtccctttattaatattactatagaattaacttattcagttatagggtacactacgtttatagtttacttccttcctcccccagcctccagctttgtaatttaaatgaaactaaattccatcataattcactcactaacacataggactgccaacctctgaatggctttagatttgcgtgaacctgtatttgtcaatgcttgctccaggattctattggcatatgtcgaaataattgatttttatgacaacctgcttcctgcttactgttttttaccatagggagggaaaaaatagaattatcccttgatttagctgtcagtcaaatgacaactcaagcatgctataaaattaaagaaagccccacattctaccaggaactgatgattttagtgatactgctctctttgtagaagaaataaagtattttcatatcttatgatgaatatcactataatacattaaaatatagaattgcatccagcaaaatatcctgaagtggacaaaatatgcccctccaaaatatgccatttttgcacaataatttttttgagcagaaagcaattagctcactgactttcacctttctaaaagcaagacataaatttcaatttgtaaagacgtctccctttagtgtacttgtaagaaaactactccatagacaactcttaatagctgatgacttatctgcataagaaactttattaaacaatcctgatttagaatacatttcttcccccactttcccgtaacttacctcctgcaccgagcagccctaaacttcttttctttggctagtctaagatatacaccccaaatcctaattgcctctttgcatcacatttctttgtgaatttccatgtgtatgtacataattaattgttatttttcttgttaacttgtctgtgatcagtttaatttgtagggtcccagacactgaacctaggatggaagagaaaaagtgtttctgctttcctatggcttaggcaaccatgaatggacaggcagggcatcccacttgctccagaggctgcagctcaattgagatctgacaaagctgatgtgaaaactttactgaaccagatcctggaattttgcctacaaaaatacaaatacagaactctgttttttcttttccaaattcagatttgcacgagaataaaattataagaattagttctttggaatgtgattctggtgaattttctcctgagtatcattggttattgaccctttcactcccagggagagccattgctttcctgtgtgtctcattttgtgtcttgagcgcttggattcactttcttcctggtggcagggtccacattgttgggcttgctgtacaggcagtcagtcatcagattgtatgccctgagaatttgtagatggtcagatagagatgcaggttgcactgtcttgctactgatgttctaccaaccctctcagagggtttgtctaaatttttatttcttttggctattgctgggaggaactccatatcataaggacttcatttttgcactctctttgtggatacctcttacgttcttggctatctacattattaaatatgttttttccctctcttattaatcttttatttatttaaaagtggtgggttcccatggccttgggcatctctgcctctgtggcttcacagggtatagcctcatcctagctgctttccccggctggtgttgagtgtctgcagcttttccaggtgcagggacaagctgtcggggaatctaccattctgggatctggaggaaggtggccctcttctcacagctccactaggtggtgccccagcagggatcctgtgtgtgtgctctgaccccatatttcccttctttactgacctatgagagtttctccatgaaggccccgccactgcagcaaacttctgcctggacatctgggtgtttccatatgtcctgtgaaatctagggggaggttcccaaacctcaattcttgacttttgtgcacctccagctcaataatacatggaaaatgccaaggactggggctaccaccctctgaggcaatagcctgagctgttccatggccccttttagccatggctgaaggggctgggatgaggagcaccaagttactaggctgcacacagctcaggggtcctatgcccagccgaagaaatcactttttcctcccaggcctctgggcctgtgataggagagtcggctgtgaagacccctgacatgccctggagacattttccccattgcctttgagtttaacatttggctcctcgttacttattcagagttctgcagctggcttgaatttcttctcagaaaaagagatttgccttttcaatcatatcaggctgcacattttccaaactcttatgctctgtttcccattttaaaactgaatgctttaacaatattcaagttacctcttgaatgctttgctgcttagaaacttcttctgccagatacactaaatcatctccctcaagttcaacagttcacaaatctctagggtaggggcaaaatgccactagtctctttgctaaaacataagaagagtcacctttgctccagttcccaacaagttcctcatctttatctgagaccacctcagcctggattttatatcattattgacattttactcaaagccattaacaagtctctagggagttccaaaccttcccacactttcctgtattcttctgagacctccaaactgttccagtctctgtctgttacagagtcccaaagtcacttacacatttttgtgtatcgttttagcagcacttcactcctggtaccaatttaccgtattagtccattttcttgccgctgataaagacatacccaagactgggaaatttagaagagaaagagatttattggatttacagttccacgtgcctggggaggcctcacaattatggcagaaggtaaaaggcatgtctcacagggcagtagacaggagaacagagcttgtgcagagaacatccccttttttaaaccatcagatcttgtgagattattaactaccccgagaacagaacagcatgggaaaacctgccaccatggttcaattatctcccattgggtccctcccacaacatgttgaaattaaaattgggatttgggtggggacacagccaaaccacatcattggggatggaactttttattgtgagtatgtctgcacaagttacctgtgtagattttcttgtctgtgtggctgtgggaatgtcttagtcaaacacccctatgcaagtttacttatctatgactatagtttgattttttaggctgttcttttgtttgaatgaattcaactgagtacccaccctaactgcctgcctgactggtttgtttatttctcctctctcatttttacccacgggagtggagagcctaactgctgttagcgaggtggggtgatgctcgctacttcctgctggaaaggggcattgtatggggaacagcagctagggttccttctgtgagctttctaagggtccttggaagaaatttgtgtccatgcatggtttcatttgcatcaacatttgtagtttgatagactttaggcaagaaaaaaaaatggattattagaggacatgtataaaaatgaaacaaggggataggtaatgaaagctcaaaaatctcaaggcttcagccatgcccagataaatagtggctatagttatgcctactaagatttgggtgcatggggctttgctttggtgaacttccttggttttattttcccaaacaaagaaacctctgggttatgggtaccctgtatactcccataacctggtaggatttgcaggataatagcccaaaactagaatattgattcagatttttacactacttattccttttttattttgagttgcagccagagattgctggtttgtttacaggaataagcagagttattctaaaatgtacgtgatatggtttggctttgtccccacccaagtctcttctcgaattgtagctcccataattcccatgtgttgtgggagggatctgtgcgagataattgaatcatgatgggtgtttttccccatactgttctcatggtagtgaataagtctcaggagatctgatggtattataggaggaaatccctttcatttggttttcatcctctttcttgtctacttccaagtttttgccttccatcatgattgtgaggcctccctaaccatgtgaaattgtgagtccattaaacatcctttttaaaataaattacccagtgtcagatgtgtctttgctagaagcatgagaacagactaatagagtaggcaaaacttaaaaacaactaatgagattagaatttaatgacaagtgtatgataagttttgaatcaaattttgctctctccagtcctcatttttgttcaaaacaaatcatgatagtcattttgttaaaaacaaattacgactgagttgtttgcaatgtaaacttaggctcatacttggcttgattatttgcataatgtgcagcaaaaataattatttttgcagtcttttaaaataagctttgatggaactctgttccacaagagatctcagataggacttttttaaagccaagcccggccatgagtttgtaccctcaaatacctatgagttgagtgaattcctctcttcttaatgtcacaagaatatgtggttcctgggactgttatatagtgacattctttactcatcacagattagaaaccccgtacacagattatgtagacaaggtaggaggccacatttcccaatgggcttttattggctctgtaagtgaagcttgattcctcaaagagaagcatatccatccaatcaaagccttggtaaaacaaccagtttctccaattgtgtcatgttgcaaaagaaaatgaattcttactgcactggtgcaaacaacgatattgccataagtttagaatattcccaaatagtttccaaattctggagtaacttggcagagagaaacaaatacgctccaaattttgttcactggtgtataccttacttaattcttaaaagctgtagatagcttaaaagaaaggtttccttaactctgaagaacaaaacaaagaacagcaatgttttaagcaaaaagtaaaaaaagattatttcagacttctattagtttagttcatgcagttaactcctgtctgatattcataaacagttaagatcttcatgactcttgtatgatttcttttattctcatgtcatgatttccaaagttatcagaaacctgcatttgagagcacattgtaaagtcctacagctgattgtaaaacatcttttgaagaggattaaaacaagacaacatttatctgtagatgacatagtgttcaggttagttacagtgaaaaacatgactggcaaagatatttggttatttctgtggtttgcaataacttaatacaataatcctaattatgatccatagcatattctcaagcattagaatttttaaaatcccatacaattttggaacatatattaatattatcactaaaatataacctgaataaggttaaacataattttgtcaatcccacttacatgaacctgtcaaaaaattctgtttacttctcttctggatgcttcagggccctctgtagcatacaaaaggtagggttcaggagagacaattttgaatgtgaagtttgattttgggaagcctgtcaaatgttacaggtttaaaacacttgatagtgtgaaatacaattccaggtaacacataagttatttattttggcaaaaggatgactcagaaattttaaaactaggcaacatcctttactccttaagagggaggacttcgctttccaaacagtttgtctcctgtctactcttttctctctttggcagtctcccaacaaggcaaacaaaatatttcattattcttctctattacatgaaaaatctgtacaagggaaagaaagccaaattttacccttacattggtttcaaaataatcctttttcattggcaaggtttatattttatgcctttttataatcttttatgacaaacacattttactgttcttacacaccttgcaggtaaatttatttttagttgtcttatttacatgttttaatggtaaatcttaccaattttaacgttaatataaaacctggtaagttgttttaattatgtactagatgcagataaagtctgatttttccatcatatttaggggcatggttaatttcatatgtccccaggccttaccaagttgtaaggtaggtagcatacaaccttgaaacatttagcaaacctggtatctaacttacatgatttaaactttctatttacattttgatgacatttgcattgtaccaatttcatctttaaaacaattactatttcttagaggttaaagtcccataaactaaaaggcattagagttttaactttcctctaaaatatttgatttaagtgcttatttttatttaaggcaatcaattagagctcattagagacatcacacacaacacatatatcactacacaggcaaacagaagaagatccagtagttctaagatttttttcttgtcccatttcctaattgaattattagctttccagtggagccctttaagagcaaggatagaaaaccatgaagtttctagggcctaatcaacttgtatagctgtaagacaaaagcagattttgagtggaatctatctatgagcctctaaattctggtattccatgaggaaaacagaggtttctcccaaaatggaacccatcatgccttttctgtttttcccaagaagtatcaggccagcaaaagttatcttgggttcattaagagtggaaagacagagtggagaaaacttattcagtcaaaacaaaagttatcttgggttcattaagagtggaaagacagagtggagaaaacttattcagtcaacacaaaagttcttttcaagaaaaacacaatccaagaagagaaaaacataaaggccttttaaatatacctataacatgaatatccacttttaatcaagctgagcattctttaagaaaatcatttgaaatatgctgttacctgactttagctaaatcaagcaggtaatatttctggcttttgactttaccaaaagtaatatcaaaggtgaaacaacaactctcaattaggttataagttaaccacgagtatacaagatatcttataagtggtggtaagcagcttttaccagatctagaacctttaaagtcaattcagagaaaagaagatttcagaaaggaagttagagttgttcatggaggaggaagagaagattaaaagtcacacagctattaacttgtaagtattcattacccaaaccaggagcgaacccgggccaccattataaaaaggcaatggctaaaaagaagtactgccacattgttacaggttatggtcaaggacataaaacaagatggagacttgcagcaaagtttgttactaaccagtttacaggggtgacttgaacagtgagcttacggagtcccaggcctggattccgttccaaggtaccctctctctgattgtttcttgtattttctctcctttttctgagactcctcctagtacctgttatgaaagactggggtggctactcttagaaggttttttaaggtgccatctggttctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagggttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatttcttccaggcagaagctagaaagagaggtttgaggtttaacagactgtcactatatatgcctcccagctgtagaaaattaacttgtctcattaataaactgttcaaattcatttagcagtggtgagcttttacatgaaggaaaagcaactaaaatggagagggatgagggtattcactcgggatgaaatatcttttcatagagtaccatgaatgactgttattgtgggacaaaaagcacttactgggtgaaggtttagactgaaatcttgaaatcccctggtattttgagtttctgcttagcctttccaaaggaataaaatcagatatgtatctatctcagtgagcagaggagtgactttgagtagaatgggaggaaggtttgtcctaggcagtttcccgcttgaattttccctagtgatttcaggggcccagtatattgtcctttcacacatctgacaagtaattgataaccagaatatctaagcagctcaaacaattctagaggaaacatatctaatagttggatcaaaaagtgggcaaaagatttaaatagacatttctcaaaagcagacagacatatggcaaacaagcaaatgaaaatgtgctcaacatcatcgatcagagaaatacaaataataactacaatgagatattatctcaccccagttaaaatggcttttatataaagacaggcaataaggattgctggtgaggatgtggagtaaagtgaaccatcatacactttttatggttatgtaaattagtacagctgctatggaaaacagtttggaggttcatcaaaaaactaaaaatagagctatgatgtgatccagcaatctcacagctaggtatatacccaaaagtaagaaaatcagtatattgaaatgatatctgcactcccatgtttattccagccctgttcacaatagctaagacttggaaacaacctaaatatccatcaacagatgaatggataaagaaaatgtggtacatacatacaatggagtactattcagctataaaaaaaaatgagatcctgtcatttgcaacaacatagatggaactgtacattattatgtgaagtaaaataagccaggcccagaaagacaaacatcacatgttctcatttatttgtgggagctagaaatacaaacagtggaactcatggtcataaagagtagaaagatggttactagaggctgagaagggtggatgggaagcaagtgggaatgttcaatgggtatagaaaacagaagaatgaaaaagacctagtatttgacagcacaacagggtgactatagtcaataacaacttaattgtgcattttaaaataaataaaagaatataattggattgtaacataaaggataaatgcttgtggtgatggataacccatttaccctaatgttattattacacattgtctgcctgtatcaaaatatgacacatgccctgtaagtttatacacctgcaatgtaccaacaacaattaaaaatttaaaaaggtgtatccttcccagtgaaccaaaatattttacattgataacttttaagttatcatagtgtgttggaataatcacagctttggaaagaaaaaaattatagatataaactttcaaagatggcaggagatatagatctctctttagtggattaaaatatgccatttgttattaacatcacactgagattttttaacacaggacatcttctggaaatgatatgattataggagttataggaaaaagcgttttttcatactgtgattacctatgctatgaagaaaggagatatttcctctatgatgtctaatttagcataattattgtttttaaactatatttagatttaattaagagatacacaaacaaattacttttagtagtaagaagatttttaaaaattttttgtgtaagatgactatgtagtaaagaaggttacaaacttactttttaacgtagaaaaataatctcaccttcttgccccatggaaaattgaaatgttatgtggaacccagtgtagaaaaactctcagtgaggttttctgtcttaagtttcagtggattgaggtgagatcaacgcctgttccacctttttcctccctgtcctagcaggcttgaaaacatttatacagccataaaatgttgcctttaaattcaagtatagaaaataaaatttaaaatgtgatatttttatatattttattttaatatcttacatgggaaatgtttttgaaatgttaaaaaattaaaatttttaaaagagtactgtgaaataatctaatcacatgtggaaattttgttactatttccccaagcatttttggtacatttaatgagttgaatgtaactcataagtagataaaaatgtttaatatttaattttctgctgcaataatgttacaaaacaaccttaaattctcagtaacgttaaacaacatatttttttctcccaaatttccaggttatttaagggcagttctgcttcatattgcagtttgcctgggctttactccaggctgtgtgttggagttaggtctaatatattgtatccctacgtatcccagttagaaagcctaacagatttctttgtacttcagtcagctcgattgtatttgtcattcaaaagccaaagcatttatcctaacaccaattgcttcttttttttttttagatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtaagccactgcacccagcctaactgactgcttcttttgttctgtagtctttctccaaaactgtttttctctgtactcactttcaccttctctcacacatatatgtccctcatgtccctttatgtctccagggtcttctatttccacgtaatcttaattgttcatcatatcctggactcatgagtaattaatctgttattctccctgaaagtgcagccttgttgaatagaatgtgttctttaaagagcagctttgtttctcgagtgaggtattaacttccagatttaagtgaaaatgagttccaagttttatgtttcattgtgtgtctaagactgacaccgtttattactgtggcacttacagcttgctttcaatgcctccaaattctctatctgaagggctgggtaccatatctcatgtctgaacatattcctcagaatcatgcagtaccagctatgttccttctttatattatggctcctgaggtgcctgttaagcagccaggtgaaattgccttttaatcagtataggaacagtctctttcctgctgatgctaatgctttttgtaaaaaggtcatgctgtattgaagttcttctttcacggcaaaaccactaatggaactcatctacttactgatgggtggaagctctttgtatgccaaagtcttgttttgtttgtgaagaatctctttccctcaacagtgatgtgctacgttaggtctcaaatcattgttgctttttaatccaaatttatgacaaagattttcagtttgtatgcataatttccttctctggccttaaccatcagtctgtggacttgccaagcaacaaccacaagaacaacaagtctgaggtcaagagacactatttagatctcagaatcatttgttgtcctttatcctttgacaaagttttgcctttctttctttatgagattttttccctaatggtttctcaatctcttgagaagaagaaagttcttgactcttgcagtctttctcattagttgaattataccatcagtacagcttctgatcatgtcgagaaatccaccatgaagaaataaaacatttccgattacatggattacgtttcttggattcttataggcattaaacttcattctaggatacaacctcatgatcttgtcttattctcagaacaagaaatatattactatatacattacaatatatatatattgcagtttccttgctatatatatatatatatgtatgtattatagtaaaccctgtaggcaagcaggaacacttcagaagtctcaatgaatccatcattagctgttagtaatgacaacactgttagaattatttcaataatcacacattgttatggtctgaatgtgcacccccaaatgtaatatgttgaaattttaacacctgagggcatagtattaggaacttgggagtggaactctttttagtgctattatgaataagatgcttgccttttccagcaaatgaggacacagccacaagctgccctctaggaactatgaagttagtcttcaccagacacaaaatctgcttgattttgaatttagcctcccgaactgtggaaaataaatttctgcttttataagccactcaatttatggtatttggttattgtatcccaaacagactaaaacacacattatttacctcctttttggactgtctggggttgttgctttaaacttgcttcagtgcctagaactgctccaagctccctgtcctctggcacacacgtataaataattctgctggaaaccgacatgtttcactcagtcatccaaatgtatttataatgttgtccaaatatatagcacttgttacaatgtttacattttagacatattttgagatatgtgccttaacagagtgctgtgattattattaatatttagtaacttatcttaccagacctaaactcaaagtttttcacaatggcaatgccttatttgggacttatttgggactgaatgtatgaagatcttacattgagtccaaattgatttctctgttagtctcgcaataacattaaagccacagaattatctgctgtatatttcttgtcttgttgtagctgatattctacatattaggacaattaggacattagtaatatctattaaccttagaataaaatgtcatattgaaattgaagaggaatattggaactttgctaagaaagaatgcttttcacacacaatgatatctaaaatggagcctctgttcctggaggtatattttacaaaaattcagtgttactataggaattctgtacacttctttcttagacatttgtattccatcagtgtcagtcctctctgtattttaaactaaataggatttctttttccatctttctgtttgacaagtattgttttgctgaaaatttgctattcatgttcttttaactcattagaaagaatatttagggtctttagtgacaaatgacatggtataaatgaaaagaaaacactgacattgtaattgagaaatactaattaattaggagaatattatttaaaaacattgtttaaatatttctttgttttattattattatactttaagttttaggttacatgtgcacaatgtgcaggttagtacatatgtatacatgtgccatgctggtgtgctgcacccattaactcatcatttagcattaggtatatctcctaatgctaaaccctcccccctcccccaaccccacaacagtccccagagtgtgatgttccccttcctgtgtccatgtgttctcattgttcaattcccatctatgagtgagaatatgtggtgtttggttttttgtccttgtgatagtttactgagaatgatgatttccagtttcatccatgtccctacaaaggacatgaactcatccttttatatggctgcatagtattccatggtgtatatgtgccacattttcttaatccagtctaccattgatggacatttgggttggttccaagtctttgctattgtgaatagtgccgcaataaacatacgtgtgcatgtgtctttatagcagcatgatttatagtcctttgagtacatagccagtaatgggatggctgggtcaaatggtatttctagttctagatccctgatgaattgccacactgacttccacaatggttgaactagtttacagtcccaccaacagtgtaaaagtgttcctatttctccacatcctctccagcctacaatgaactcaaacaaatttacaagaaataaacaaacaaccccatcaaaaagtgggcaaaggatatgaacagacacttctcaaaagaagacatttatgcagccaaaagacacatgaaaaaatgctcatcatcactggccatcagagaaatgcaaaacattgtttaaatatttctatcacaaattgacagcagtacaatgcacaccaccagcaatgtataattctagatatgagaggtaaaaagataaaacaggtattgcattttctccagaaaacttatcatttagtggaaactggccaataatttcttaggccttaggataattttacctttgattctctagttaatccaaaatatataaaaatattaaccaaaagtatatatttttaaaatgcctacataatctaatgcagtattttttgctctcttcttgaagtgaattaaattccttatcactgaccataaaattgaactccattgatgattcttatttaaaatagttaaaagtgaatgtaaagatcagttgtggttttccttttcttacccttgtttttacacttatatttgcctgtgtcattcacacacttttagaattcaaaacaataactagaaatgtaatcatttgcttttcaaaagcttttcgcatctttccaaagttaatataaagtcttacaaaacttttagctaattcacaaaaaaatcaaacatatatagttgaagcaattttttttttttggtagatttcttcaaaccacagaaatttcagttatggcatggtaggtcttttgaaatgtttcattttttgtatttgaagatgcagagcaaaagtatttccactccaactcccctttaataaaaattgaatgtaacaaaaaaatcaaaatctataggaaaataaccccttcatctatgttaaaactatgagatttccagcccaaataagttataagaaccagtatagagtccaggctcggtggctcacgtctgtaatcccggcactttcggaggctgaggccggaggatcatgagttcaggagatccagaccatcctggctaacatggtgaaaccctgtctctactaaaaatacaaaacaaattagccaggcatggtggtgggtgcctgtagtcccagctactcaggaggctgaggcaggagaatggcccatacctgggaggcggagtttgcagtgagtggagattgcaccactgcactccagcctgggagatagagtgacactccatctcacaaaaaaaaaaaaaaaaaaaaaaaaaaaaaaggaccagtatagaaatactaatacagtaaaaggtggacttatatataaagaaaataaccaacagattttgtctatggcacaaacttcttagaaattttgaggtctttagccttaaagacctaatcaaatatttattactttgaacagtgagctactgggatatgctgggctttgagcctatgtacaaatctaattttagaagtcaggacgtgttgtaagcaatagcaaagaatatgctagatgatcagcttggcaattgttgaacaaacttcattcagcagtgtgaggacgtaattaaagcagttgaccttcaatctattcactctctttattggcaaatggccgaggaataagactagaaggaagatgaactggtttagtctctttgtcagctgaacttgtggtgaaagagactactgatattttctaggatgaagagatcttatctctgaaataccctttgcaggttgctcctgactgaaacaaattcacagattctttcttctcgctcaattttgctgttgattcttcattttacattctttatttcatttattttatgctttagctctagaattttagtttgggttctattttttcaatctgtctgtggaacttctcaattggtttgtgttttgttttttttcaagttttggttgaattgcctatttattctcttgtaactaattactctcctttaaaacaattatttgacatgaaaaaccttgcaaaaatacaaaaatctataaacttcttgacaaagaattcaaaataattattttaaagaatttctgaatttgcagcaaaagtttgctatagagcaacatgaaagcacagaaaagtatgaaactcattgattaaggtaaatatataaaaaatacagaacactctaatagtgtagtagtggtgtgtaaatcagttttattgctagtatgaagcttaaaatccaaaataataataattatagctacaataatttgttaatagatatagaatattaaaaatatataatgtgacaccaaatatataaaatatagtgggctgagtaaaagtatagagttttgaatatgatcaaacctcagtttaaaatagtttgctccaactacaagatagtatgtataagcttcatgctattcggaaagcaaaaacctatagtagatacccaaaagacaaagagaaatcaaagcatgtcactacagaaaatcataaaatctcaaagaacgacagcaagggagaaataaaggaacaaaaatatgttaaaaggctgaaaagcaatgaacaaaatgtcaattgtatgttcttatctatcaataattaccttgaagataaattcattctattctacattcaaaagccagagtggctgaatggattacaaaaggagacccaacaatatactgcctacaagagactcacttcagcttcaaggacacatatggtgtgaatttaggggatgagaaaatttgatattccatgcaaattaaaacaaaaaaacaacatggataactatccttatatcaggcaaaatataccttaagataaaactctaacaggtgataaagatggtcactatataatgataaagggatgagttgattaaagggatgaaacaattataaataaatatgcacttaacattagagcacttgaaaatgtaaagcaaacattaatatctggagggagagatacagagcaatcaataatactacagatataggtaaccttattgacactgttgaaattatcaatactccaattacaacaatggatagatcatttagacagacaatctgtaaggaaaaaaaaattagacttgatctgcactttagaccaaacggacctaacagatgtatgttcacatttcatccacagccggagaacaggtgttcttttcaagctaacaagaaacatcctctaaaatagagcatacttgaagtcacaaaatgtcttaatacatttaagaagattgaaattttatcaagtatctcttttgaccacaatggtatacaactagaaatcaattaacaggaggaaaactggaaaattcaaaaagaagtgaacataacacaattcttaaaaactggtggtttaaaaaggaaataaaaaggaaaataaagaaatcttgatacaaaaatgaaaacacaatacaccaaagcttgtgggatgcagtaagacagtgctaagatgaaaatttgaaatgacaaacacctacattaaaaaaaacacaaatatttcaaataaacaatctatcattaaacctcaaggaactagaaaaaaagaagagcaaactaagcccaaagttaatagaagaaagaaaataagaaagatcaaagcaaaatagagaaatagagagtagaaaagtaatagaaattgaaagacattctgtgttcatcaatgtgagaaattaatattgtcaaaatgctattacacaaagcaatctacagattcaatgtaatccctatcaaaagtccaatggcatttttccagaaacagaaataaatcctaaaatttgtatgaaattacaaaagactataattacccaaactgatcttgagcaagacgaacaaagtaggaggtaccacacttctcactttcaagttatattactaaactacagtaatatatatatatatatatgatactggtatgaaaacagtcacatagaagaatggagcagaatagaaagcctacaccaatatcgtcaaagaatcttcaataacatgcccaaaacacctaatggagacaggatagtctcttcaataaatagcgttggaattattggaggcccacatgcaaaagaatgaaattggagtgttatgctatgcacaggaataaattgaaaattgaaaaggaatttaaacataacatctgaaaccaaagaatccctagaagaaaacaggggaaatcctccataacattgaccttggcatgatattttggctatgaatcccaatgtatagacaagataaacaaaaataaacacatacaactacatcaaactaaaagattgtggcacagtaaataaataaataaataaataaataaataaaaagtcacccatggaatggtagaatgtacttgaaaacaatatatctgataatgcattaatatctaaaacatataagaaactcataatcagaaaaaaagtaacctgattaaaacatgagcaagagacctgaatagacattttttcaaaggaagatttacacacggccaacacatgaatgaagaggtgcacaaaatcactaaacatgagggaaatataaactggaatcaaaatgagatgtcacattacatctttcaaaatagctaatatcaaaaaggcaaaagataaatagtgttgacaagaatgtgtcgaaaagagaacccttatagagttttggtgggaatgtaaattggtacaaccattatggaatacagcatggacactcctcaaataattaaagatgtaccgtatgttacagaaattatacttttaggcataaaagtatatacctgtgggtgtgttggctcacacctgtaatcccagcactttgagaggtgagggaggcagattacctgaggtcaggagttcacgaccagagtcgccaacatggcaaaaccgcatctctactaaaaaacacagaaattagcccagcgtggtggttggcacctgtaatcccagctacttgggaggctgtggcagggagaattgcttgaacttgggagacagaggttgccatgagtcaagattgcatcactgcactccagcatgggcatcagagtgagactccatctcaaaaaaagggtatataccttttatatacttttccttttatatacgatagaaataaaatcactatcttgaagagatatctgcattcctgtgttcattgcagctttattcacaaaaaccaaaatatggaaacaatctaagtgttgacagatgagtaggtatgtaaattatgatatctatcatctatctgtctatttatctatctatctatctacaacggaatattattccgtatttaaaagaatgaaattctgccatttccaacaaaatgaacgagcctagaggatattatgccaagtgaaataagccaggcagagaatgaaaaatactacaggtacaacaatgaaaacttgccattataagatgaataagttatggaggtctaatgcacaacagggtaaaaatagttagtaataatgtatgctttaagttcactgagtgtagatcttaactattaccctttcccaacacatgataactatgtgaagacatgaatatgttaattagcttgattgtgaaagtccttttaaaatatacttgatgggcgcagggtgagaggagagtgagggtcaaaacactacctgctggggactatgctcactagctgggtgatgaaatcatttgtacaccaaaccccagcaacatgcaattacccacgtaacaaacctgcccatgtacctcctgaacctaaaatagaagttgagaaaagaaaaaaaaagatatcaatttcctataaggagctccaggtttgttccaaacagtagcgagacaaacagatcaaggatgaaatatataaaatagtaggcaaaacgtaaacaacatgtgtaaggcaatcgattctatataactcagcaactcctagggttcttatcaaataaaatcactgatgtgtcataacttctaaactaaaaacaacacaaatgcccattcacagtagaatgaataaataaattacttttgcttcccgcgatgaataccacacagcaattaaacaatgaactgctgctacacaaaacatagatgattctcacaaatttcaactgagtgaaacaagtcagactcaaaagattacatacagcaagtttccatttatatgaaattgaggagtagggaaatccatcgtgatagatttcatgataatgatgaccattggtgagtaactggttgagaaagtgcgagagccaggggtgtgggagctggaaatcgtccatatcttgcttgatttgggtggtggtgatagggatatatacacttataaaaattataatgctatatgcttaagatttatgtattttactatttgtaagatatatattagttgaaaaaatgcttcagtgtaaaggaaaccagtaaaaatacgctacctacaattgtagcttttgtttatcaaaaaagcatttgagtagtctattgattggtaattagcaagtttatgttaagcagccttgtcctgaatactttttagtatgtaccattaagcatttgcctttctcaactagggctaattaaaaaaaactcaaaacctcacattgtacacgttgaatatatataattttaatttgtgaattataccaccataaaactaaaaatctaattaagttgagtttgaatacattttagggaaaatacgataaagaaaattaggagcttaagaatatgcatagataaaaaataaacttgatagaaatattatttatatattatatattatgtatatttatatatatttatatataatatataaataataatatatatataaataatactatatgtatttcagaaaatcatataaaaagctgtgctaaaattttccagagagagagtaaatagttctcctgtagtggattaaaatgagattagcattggagtactagcgtaatacaacagatagagtctgaagtcagatctcaaaaatacaatatatttgctaagtaatgcgagacaagctatttaaagtttttggacctaaatatccagtctgtaagtttgttggaaaaaataaatacgctaatagagaacttaacttacagggagtgctaaattattacctgttactggaaaacataatatcagtgacattaaaagcttgagtgttgtagaacaatattttgaaatatcattttttgaagttatatacatatttatattactttaataatttgcacaacataggaaggaaagcttgctttgcacaggcaacatttttgccaaataatctttaaatcatcatgaattctcaattagattaacaataataaaattttattgtagaagactattttttcattaatatagttgtacatgcacatagggtaaatgtaatattttgttacttgcctaagctttataatgatcaaatcaaagtaaccagggtgtccataatctcaagtattatttccatatgttaagaacatttcaagtcctttagctattttggaatatacaatacattgctgtttatatgtagtcaccttactctgctatgaaatattagaacatatgtcttccaagtaattgtatgtttggacctattaacaaacttttctttattcctcccacccagagaaactttccagcctctggtatctatctataattctattctctacctccatgagatcaatatttttagttttcatgtaagaataaggatatgtgatacttgtttttctgtgcctggcttatttcacccaacacaatgacttccagttccatccatcttgctgtaaatgataaaatctcattcttttttatggacaaaaagtattctactgtgtatatatataccatgttgtttttattcattcatccattgatggacagaggttgatttcatatctttgctattgtgaatattgcaataaatatgagagtgtggttatctctttgatatactcatttatttacctttggacaaatagctagtaataaatagcttgcacctctggtctcagctacttgggagactaaagcaaggggatcacttgagcccccgaggttgaggttgcagtgagccatgatcactccactgcattctagcttggttgacagagtgagaacctctccctcctaaaaaaatccttaagaaatgtgttgatgcctggttcccttggtcagaattttcatttgatgtgttgagagtgtagcacagatgttggaatgaacctctcaagctgattttaatgtgcaaccaagtttgagaaccaccaaggaagagtttttatgaattaagattcctatactctatcctagaactaatacaactgaatctctgggaatggagtatcagaatcagatttgaaaaggtttccttagtaattctaaggactgagcagtttggatactcgtttgttagagtaaaatggttaggtacctagtatcaacataggcacccaacctgatattaataactaggaaaataaagggttggcgcctctgtgtttctttgttgaaaaatctgatactattcttagttctatgaaaacaattgaaaatttggttattatcaccttaaaagtacaaaacctatagatattgaaaatgtaattatttttctataggcatagttgaaatgattttgtaaatgttataaatcagtttctttataagcagttcatttacataaattttgttaaactgacatgattcactaattttctaaatataaatggttcagctctcagttatttttaaactaatgacctgtgttatacttactatttttaatgggcttttatgatgtttttaggtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatggaatagtgtttgcattttttgtttacctggtttaagatgtgcagcagaacataactagatgattacataatttctttttaaggcaattttataatatattttatttatgattataaaaactgcctttaaaaattcttacatggatatcaatgcagtttcactttttttattgtaatcttttttataattattttatacttgtctggcattgagttttattgggcttttggttttttggaagtagggtatttatcccaatttagaaaatttgtatccttgccataatacagtcttccatttttgtacccccaaatctttcatctgtcagaacatcactcaaaggtgaaaatatttcccacataaaattattctgttcctttaatgaaatgagtttcagctgtatataagtaggaaaacttccttttgttctatttgattcctttttacggatactttcttgaggctgtgattacacctttaccttagaggcactgcccaaaaagactcagctcttctgtaaaaatgctgttatgaatcatagcttcttaacttttacaacatagtgaggtagggaaagtaagaacactagagataggaattagaagcatggagaagtgaaccctggagcttcccaatggtgagataccaaatagttcaagaactagtaaagaagactacggaggaatagctagaagctaaatgaagaaagtatctcaaacaggaaggagtgatctgttaatgtgttaggaaagttgagttcttaggattaagcattgggtagagcaagatttgggaccttgactttgacgaacttggtggatgtcaggagtaagaggaggtattcaagagaatgttggagaggaatttaatatagtgagtattgaggacaacacttaaggagtcttgctttcaaggggatgtgagaaatgggttgttaatggagggtaatgtagtatcaaaaagctgtttattttgagatcgatgatatagtaggtttgtatgctaatgggactgattcagtagacagaaaaagcataatgcaggaaacagagggatattgctgaagccatagacctgggacacaaatagaagggttagttttaaagataggcccacaaacagctcattagtaacagcaggatgaagggcagattatggagttccagatgtttgtagtccagtagataggaggagcatgtcaaatttttgtgatattttctcagtgaaacaggaagcaagctcataaagagggaggaagtcacgaaggagtaaggaaggaaaaggagatgtaaaatgaatagataggagtgtaggaaagtaagcatactcttaggaaatctgtggtttatttaagtggtatcagtcaatgtggttctgtgtttttctccagttgagttcagcataggtgctatcactgaaaaagtacagaattcagtttaactaaaggtgagatttctctaggtgaataaaacagtcagtgatgagatgttgatacatttaagagaatgattataaaagagggatgtggaaagtagtctgggttaagtagtgaagtgagaaaataaagaaggttgagacagtggaaaatggaatgatcaattgtagattgcagtgtggttgaagatgcaatggacttcttgaggtgggaactagaaatttgggggatataaataagagaggggtgactgaaattgaaaatatgagagtataatagtatacaatattactaagtatggtatactaagtatagtagaatagtactaagtatagtagaatagtactaagtatatagtacttagtgagtataagttttaggatgtgaagaggggagtagcgtagaggcaaggtgatggaagcagatgagttcaagaaaatgagaacctaggagattgaaaccattatctaaatgaattctgaaatctcaagaagaactgtgctgagtgcttgtagtcattattttgtctttactactctgtgagaagacagcacttccttttgtgagtaatggaaagttctttaatatgtcaactgtaagatactttattacatttaattatctttagtaatgcatagtaataactaatgacctcagtaggattattcagtagatatgtgagctaaccccctgtgtcagacacctaagaggaacaactgatgtttttcaagacgaatagagggttctcatcccagggttttaagctgcaaaatatcccaccctatattttctgaaaacaaacgttatatagagtgtccacataaaagctaacaggaaatattacacacacacacacacacacacacacacacacacacagcattgaaaatgcatcaggaaagatataccctgtacccaacatgcacaaggtctaagcaatgaagaaaatctaggaaatcaaataagaccagaacatctatgactaatatataaatacttgaggcagttatatccatttaaaaggtgtcaattagacatgaaagaaaaaggccaggtgcagtggctcatgcttgtaatcccagcactttgggaggccaacgcaggcggatcaacgtgaggtcaggggtttgagaccagcttggccaacaaggtgagaccccgtctctactaaaaatacaaaaaaaattgctggttatggttgcacgtgcctgtggtcccatctacttaggaggctgaggtaggagaatcatctgaacccagaggtagagattgcagtgagctgagattgcgccattgcactccagcttgggtgatggagtaagattaaaatatatatatatacatttttacataagaaattttattttaatttttttgtaaattagaaaatagcaattaatatggtatttatataccagaatctttgaatatctaaaatttaagaagatgtgagcaatttcatgaaacttttcaaagcttagaaaaaggtagctatgtaaaataacaatgtatgttgtttatgggaacattagatgaagtaagtcatgaaaacatgcatagaaatgatcatataaacttgcaagaaattgaatgtcttgctatcaaaggaaaggatggaggtgtaagagactgaggtagaatgtgagaagctctgtatatattgtattttccttaaaaatatatatttaaactcgcatttcttgtttttcaaatgttcactctaatgaaaattcttttatttttcctgttacagtttttatttctgatctcatatatgcagtgtactgttgttcagaaatatcattgatcctccctgcaaatgaaatactctcatcctgttgaatttgagaatgtacacatgatttgctttggctttgaaatgtgagcagaaagaatgttttactttggggagttcccaattgctaaaccatgtgtcaaaatgaagtttttgtgacattacaaatggactaataagagtgcctttgttgatcctagttgaacatgagaaacttggttattgtaagccactgaaaaattttagtttcttttattactgcagaatagcctattctgtcctgattgatacagccacaacatttccttaagctctttgattttcatattgccattaggatgtagaatgccaagagaaggataaatcataggatcagagaatgttagcagtgaacgagactattggaatacattttttcaatggtttccagactttgggttctaagtaatcagtaatatttcgaaaaagtagtaaaagatatttcaatataaaaaataatgacatttaactttgaaaaaaaaaacctatcattgctaggcataatgggtctagcttgtaatcccaacaacttgggaggctgaggagggaggatcacttaaagtccaggagtttgaggctgcagtgaaccatgattgcatctccacactccagcctgggtgacatagggccacctcaacaacaaccaccaccaaagctatcattaatacattgttcctctgtctctcttcccatcctccttaccacttagtcttaaatctaatcttattaaacaatatctaaggaaaagataagaaaaatgatggttgcatctatactgaacatgtgttgacttttttcttgtcactattttctaaacaacacagtatcacaacttttgacatagcatttatgttgcattagttattataagtaatctgagatgatgtaaaggttatatgcaaatattatattttatataaaggacttgagtaattattactttaagtatccatggtggttcctggaacaaattcctcatggatatggagggaggaggaatcactgtaattaaacaaatcatcactttaaaacttaaaaccttttgcatgttgaatacagtcatgcaccacataaatgatggtggtcccattaagtttattatgccatatttttatcggaagtttcctatgtttaagtgtatttagatacacaagtacactgtgttacagttgcctatagtattcagtaaaataacatgctttacaggtttgtagtctaggagaaataggctaagccatctaggttaatgaagtccattctatgacatttgcacagtggcttaattacctaagggctttctcttcagaacctactcttgtcattaagcaatgcatgactgtagttggacaaaaaataataatgcaggcatacctttggcactgtcctaattcttaccagcatccatgattgcttaaatttgcactggaaagacttcaaaaaacagtgatatattaggacaatatatttccagtacatgacaaatgataacaacataagaactcgaaacactcaataaaaaacaaaaaataaagcaaaactagatgggaaaaggaagaagcaaatttcaagagaaaactcaaaaggccaaaaaatgtgaaatgatgttcagccttgctagtaattgggaaaaacacaaatcattttttttttttttttttttgagatggagtctccctctgtcacccacgctggagtgcattggcgtgatctgggctcactgccagctccacctaccaccttcaggccgccattcccctgcctcaggctccagagtagctgggactacaggggcccaccaccatgcctggctagttttttgtgtttttagtagagacagggtttcaccatgttagccaggatggtctccgtctcctgacctcgtgatctgcccgcctcagcttccgaaagtgctgggattacaggagtgagacacgtgcccgacccaaatcatttttaatctattagtcaaaaattagagctatgataatattaatttttggtgggagtgtggcaaaaggtactataatatactgctactagagagtaaaaattgataaattttgtaagggcaattttgcacaatatgaaaatataaaaatatgcttcatgtttaccatacatttatctagcatacagaattacccatgtgtaaacatgtatacagatgttcattataacacttcttataaaaacaaaatatttggaaataaatgttcatattaataaggcgcataccgtatgatcttagtccagttagaatattctgttttatttcaatcctttaaaagactcaacttctgactctatatagacgattaaaaaaagaatgtgttctccctttgtgcatttggtcaggtaaattaaaaaatacaccacatgctagccgcaccaaactggaataagcctttggaaagaagttgtccttgaagcttgtatctgacattgtagcaggacgagcctcagacaaaacctctcagacactgagttgtagaaggaagggctttattcagctgggagcatcggccagctactgtctcaaaatctgagctcccggagtgcacaatttctgtcctttttaagggctcacaacactaaagatttcacatgaaagggtcgtgattgatttgagcaagcaagggatacgtgacaaggactacattcactgctggtcagggagaaacagaacagggcagggagtttcacagagttcttttatacaatgtctggaatctgtgaataatatcagcttctaaatcataagttgatttttagctactgggtttaggccaatcaggcccaggcctggtttcaggcctggcgctgggctgcatgtctttggttgtacttcctggttgtttttactgaatagaaaacaatataaaacaaggagagggtctttgtctcctctcaatatcagcactggattgtagaatgtgttgctgattttgaccttgtattcaagttaactgttgcccttggtatctgtacatatctttgatttcagtctttactacacgtggcttggtcacttcatggctaaaaacatgcttgtggaagaccagtctggctcggtgagtctgtgcggccagcagtctctgatctgtacagggtattaatgtgtcagggctgagtgttctgggatttgtctagaggctggtaagggcttctggaccacttgtttctgtcctgtcagtctgtcagggttggaaagtccaagccataggacccagtttcctttcttagcttacgttatctaccagagcaccgtgggctgttacttaccttgagttggaaggggttcgcatttatacctgtaaaagtattcatccttttaatttatgtaaagtttttttgtatgccattctggatctttaaagagatgacaacaaattttggttttctactgttatgtgagaacattaggccccagcaacaggtcactgtttaaggaaaaataaaagtgctgccagaacctaagaaaaacattaatatctaaaaggtcatttagatgatttccatgagagactttttgatgttctttacctgttaggattattattgataatccttttcagattatgaataaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtgggtatgattcatagtatcaattgcggaattcactgtgcttgtaggaaatagtattctgatcttatctgtgaagcttgggcaacattttacttcacaggtaagtattctaagtaaaagagatttctgagggaaaatctatgtagtattcttggcaactttatattttgtttctgagataatctttcttcaccaagagccctccaatgtgctgttaatattttcaagagatagctgcctataccaagattcaagaatcttttatactattgattagtttctagaacattcaatgatacacagtaagacagaatttggtacttatgaagactgtttaatttgtaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggtaagtgaattctagtttcctttaaaaataacagacaggaaaatggtttctctctcttctttcttgctccttttcagcagaaaattttccgtattttatttttttaattttacttcataatttaaaactcaaaattaactgtttatttatgttcaacttttgtgaatatttgtgtgtgtgctatctactaaagaggtaagttaaagtttaaatcagaatttgcttctaaagcaaaacatcaaattttaacccttataactgttcgtatttcccggaaacaatttactggttaggaagtataattccagttacaatgtttgctatcatttttaggtgacttgtgtctccatccgtaattcttgggtttttcatggtgaatagctagcttctctatttaatgaggagcataaattgagattaatagctaccttgtttgtcttcaaaagcttcatagagagtacaggctttctcctggtgacccactgaaatttccaaaacaataacctttccactctcatctgagttttgtcttcccaaagtgggctttttgcatttcctcctatttatggtagtttctggtctctcaatttatcattcctataaatatttgaccaagtgtctagaaggcatgtaggtgtttagttcacattactttcctttcacagttgatttttgatcttgtaggaaaataattataagatatcatgaaatattttggagttttattaacatactataaacttgcatcaataatgctttaaatttctacctctctgtaagtcacactgaagtagaaactttgttttctaggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtaatttttttacgagagtgatctgaataaaagagtaatatatgccttttcttgtagacatgtagctaattgaatttcatttaaaataggaatttagatctcttagggacagaagttaacaagtttgactactttaagaaactcaaatccatatttaagaactttcaaatattgatttaagatttttaatcaatacacatttgcccacttctaagaagttcccaattaaaaatctcatcgactttatttcctaaattctctattttctattagaaaatatttcaaagatacatctgtagtagaatgtgagcatccccagtgcccaatgcaaggaagtcactatagaatatctcttgaggaatcatggaataaatgaataatccaatggattctcaggagaaaaatgaggttttatgaatcaatcataacatttttacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacttatatgcctataaaatatcatcttattcgttagaaaattaatggaagatttaattaaaaatgcaatttctgtaggataaggaatgagacatttacataaaacagtgttctttaacctcctcttcttcacatacagcatatctaattctttatcacaacatgttttatggaggtacacagaatgtaggatactgataatagttatgtctttactttctttggataatgaaacaagttaatatttatcaaggaatttcagtcgatactaaatgttttattagtgtgagctcttattattatcattgatgtagaagactaaaaattaggtaagtattttcacaggacaacaggtatctttgacattatgcttctttcaatattgtagcctatactttatcaaataaaagaatataagaatattacctgttgagataataggaataagaaaaccattttgcacatttcgtgtaacaaacaggaccaggcatggtggctcgtgcatgtaatctcagcactttgggaggctgcggcagggggattgcttgaggccaggagtttgggaccatcctggacgacatagcaagaccctgtctctaaaaaacaaaacaaaacaagacaaaaagaaataataaatagcttaatttattaataaataacaaatagcataaagctatttttatataatattaacttattggttaaaatgctttaaagtccttacacaaaatgttattgtttcctaaatttctactaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttccctgaagtatttcatggatctattagtcatactacctcagtgtgacttatcttctggaacattcttattcagacaactatcaaagagtcaattgtgaatgataagtattctagtgccctaaactctaatcaatcatcttttgtatttagagtgtctgtcacaaggcaatatgtctaggaacgctaaacataccctaggagttttcatctaagtacgagatgaatatactggatttgactgatgtttgcatataatcttttaaagccaggttattattaaaatgatcctatcatttatgaagtatgtacaaagtttccatcctgtagaatttacatgtattatatgaattaaaaatataaaaaatatttatattataacaatacagtattgaagccttattttaatctagtttgattaaactagattggtctagtttgattaaactagattaaacttcttggtctaggcacatgaatattgttgtggggaagagaattctgtataatgtgatatggatattgatccttctggagtgcctctaaatgataatgtgctgaaacctctgaaaggaccttttttaataacaaaaatcttatatttgtaatatgaatgtaagtattccatacatgtatatacaaatatggaccatacatgtagattacacatgtgtgtgtgtttgatgtgtgtgtatatatatgtgtgtgtgtgtttgtgtgtgtatatatatatatatctcttacaggaaaagcatttaattagagaaagaatttaatcttcagatgccatgccttacagagagagatgcacagttaagttactctcaaactgttgtgaaatgatacatcaacgtatatcttatttttcaaaaataggaactggggagaaggttggggtttcgtaccttctgacagagcgcttgtctttgtggataaccatgacaatcaacgaggacatggggctggaggagcctctattcttaccttctgggatgctaggtagaaaaccaagttctctatttttttaacacgtcttttaatgatggcaagaatattctgacatcctatgaaaatataattatgtaacttccaggctgtacaaaatggcagttggatttatgcttgctcatccttacggatttacacgagtaatgtcaagctaccgttggccaagacagtttcaaaatggaaacgtaagttttggagttgttcaatatatccttttctgaagaaaaaggaagcaatcttattctaacttaacatgacaactattaattatatatttattcaacaaatatttaattgattgtaaactggatacagggctgtgattttagtaatgtaggttatattaaaggagtaaaatttatattctccattgacaaagagtatgcaagctgtttcagagatatgacaaacatccccttagcccgcagggaaacaaaaaacaaaaaacagaaaaacactcaaaactaagagctagacacagggattaaaatatatacttcgaataagtacctacctcagggctgataggaagattatacatgccaacacttttagagaacttaaaacatcatctgcccgtagtgagaacaatataaatgtttgttaaatacttttaaaaagttatatggaatagaaagaaatgaatcaattgagctgagttaaatagggaaagtatcatataagaggaaggaaatgatatgtactaaagaatagaaatttagagagtattccaagaaaggtaagaatgagaaaaatatttgggagtatggtaaagacattaatctgatgagaagtttcaaaaaggaacagagaaattacagtgtaaagatatttggaaagctagtagaaggttttcttttaaactaaagggttcagaaacagcatcagagacttcagaactaaagcagaaattcctccttcctatgagtcacacggatatctagctagctttttttagattcctttcagtttgagaagtccgcactttgtatagcaatttattctattgttaaacagctttaatatttagaaggtgtacttttatattgagccaacttcttttaatttctactaattggtcttatttctgatgttaggagtcatagagtatttttattttttctattactataacatttccactttgccaggactgctgcatgctaaaaactcttagttttgttcacttttcaccatatgacatgattctaaggtcaacactgaaaaacttcctaagattcctctggattttttaatgaagattttttaaagtgccaatcagaaaaccataatatgaaaaatgtggtcaatttataaataatgttcagatgtattgttttgtacatttatctaaaaagaagcatgaatgattctaatatttattcagcacatgtcacattcaaggcattttcacatatattacttaatttttatagcaaaaaaaccaatattcccattttacaaatgaagaaactgagacacagagatattaagtgtattgattaaattttctcaggtactagtaatagagcctatgttttaatcctggtgtttctagtactaatgcccttcccatttcaatgacattgcatggcttaccacgatgttaagaagctcttgcaggccaggtgcagtggctcacacctgtaatcccagcacctagtgaggcgaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgatcatgccactgtactccagcctgggtgacagagcaaagaagcctttgcagttctttggaatgaaaaggagaggataaaaatttgttaccttgtttgaaatatgccagaagaaaaccagaggatagagagatgatgaagacccagtaaagggctataaacattaatgaaggcattggattctagataaagtcactgaatgcagagacacaagtaacaggattggttgggtttggtgtaaaggagaaggaagaggtaaatacatgcatagtaaaatttggctttttcccccctacttaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccactgcattttatttaaaacagttgaagtttaagaatatcaacgttttatatggtattgtgtttttaggaacatggttattttccgcaatgtagtggatggccagccttttacaaattggtatgataatgggagcaaccaagtggcttttgggagaggaaacagaggattcattgttttcaacaatgatgactggtaagtaaatatcaattaaaaataatattttgtaccagtatgttcttggtttattcttttttttctctgttcattgacttttatcatatctgaaaaatcatgtagtcagtggagcaagaagacaatagagatcaaaattgggcagaagcaaaaggatgatggctgttactccttcgttctttttttttcataagtgctttctgttgtaagcagaatcctttctgtgcacccttgcagtatcatatgcatatatatgatgcacatgcatatgctcacctacacatgccacaaaatcaatatataaaatcacaatcaatataaggattgtgaaatcattaaaaaaaagtgtcttataatcctgcttttttaaccatggagaaatgctgcctaggtactaaaatatctttatttctaactctttttctcaatgactgctctacgtagttttttggtacactttcttcacttctctgtctccttgtgacaaataacatttttaaagcacatgtatgaataatatgtatcttgtggttactgttttgcttcaggagatttgagttttatttttgaaacttctcattattggcctttcatctgtgattcttatatgctttacctgaagcataaatgattatctaagatatagctcagaagaccttggtgtaaacagttgaattgtccctgtccaagaccaactgacactcatacttagctcactctagtataaattatatttcactgatgaaaagtaaataaatacatcaatatacaagtcaagttgatctctttcctgccaaaaaagcccatgtctagttttttaatttctttcttttgtagatgaaaataccaaaataagtttttgtgaaaaagctttatatttcaaactatcacttcttcatagaaatgctagattatttttatgtgcatcccaaattcgttttgatctcatgggagaagaaggaggttaaaaaataataccctttaaatttttaagagtaattggtattaatttcagttgagaacaaatttgattttaccaaggtagaacttttatcaaagtgtgaccgttcctgccaatcttcagtgatattcttcaactttgatgttttggtaatattttcactactaaccaggaaattgctaggttttctgtaaggttacttttggtcctagaaagctatttccacctactagagaggcatatgggttttcttcttaataagacttcactgcttaggtttgtttctacaacataaagttatgctgtttatttgtgttagtctgtattcttgattttcattgtattgaagatcaaccttaaattttattttacaggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaatagccaagtgtgtttcttttcttacatgtacagcagtacttatatttcattaatttttactaaaagctctaattagtaattagaggttcaaaaaagttgatagtgtgaaacacaattccaggttacacagaagttatttattttggcaaaaggatgtctcagaaattttaaaactaggcaacaacctttactcattaagagggaagacttagctttccaaacagtctgtctcctgtctactcttttctctccttggcagtctaccaacaaggcaaaccaaatatttcattattcttctctattacatgaaaaatctgtacaagggaaagaaaaccaaattttacccttacattggtttcaaaacattcctttttccataggcaacgtttacatttttatgcctttttataatcttttatgacaaacacattttactgtttttacacacattttacacactttgcatgtaaatttatttttagttgtcttatttacatgttttaatggtaaatcttaactttgccattttagttaaaatggtaactttaatgtaaaacctggtaagttttttcaattatgtactagatgcagataaagtctgactttttccatcctagttaggggcatggttaatttcatatgtccccaggccttatcaagttgtaaagtaggcagtatacaaccttgaaacatttagcaaacctggtatctaacttatatgatttaaacctcctatttacgtgttgatgatatttgcattttccaatttgatctttaaaacaatttttatttcttagagatgaaagtcacataaactaaaaggcattgcagttttaactttcctctaaaatgtttgatttaagtgcatatttttatttcaggcaatcagttatagctcgttacagacatcacacacaacacatatatcattacacagacaaacagaagcagatccagtagttctaagatttcttcctgtcccacttcctaattgaattattggcttcccagtagagccctttaagagcagggatagaaaaaccatgaagtttctagggcctaatcaacttgtatagctgtaagacaaaagcagattttgagtgggatctatcagcctctaaattctgggattccatcaggaaaacagaggtttctcccaaaatggaatccactgtgccttttctgtttttcccaaaaagtttcaggccaccagacattaccttgggtgcatcaagagtggaaagacagagcggaggacagtaattcagccaacagaaaaattcttttcaagaaaaacacaatccaagaagagaaaaacatacgggccttttaaatatacctataacttgaatatccacttttaatcaagctgagcactctttcagaaattcctttgaaatcttctgttacctgactttagctaaatcaagcaggtaatatttctggcttttgaactttactaaaagtaacatcacaggtgaaaacaacaactctcaatcaggttataagttaactgtgagtattcaagatattttataagtggtggtaagcagcttttactagatctagaaactttaaaggcaatttagagaaaggaagatttcagaaaggaaattagagttgttcatggaggaggaagagatgattaaaggtcatacagctattaaattgaaagtattcatcacccaagctaggattgaacctgggccaccattgtaaaatggcaatggctaaaaaagtcctgccacaaggttacaggttatgctcaagacataaaacaagatagaggcatgcagcaaagtttgttacttaccagtttatgtgggtgacttgaatagtgagcttatggagtcccaggcctggattccattccaacgtattccaacccgttccaagatgggttgttacccatgcagaaaacggggggaatataaggtgtcccttagtctcctttctccttttgaagtgacccaggatgaagcaaaagattacaggggtgtccctgttctcctctttcctcccatctcctttgggtcccggtaaccatcataggtgctgtccatggatgaaagcatgaattgcacccatggatgtggaggtgctagctggcaggagtagtcatttttaccagcacaatgcctcctcacactgctcttctgggttcctaggcctcccaggagattctacagtagataaagttgggtgagacactttaatagagggagtgttttaaccctattcctgcctcctctagttatggacctggaaaagcagtgcattcccagaaaattttatccattgacatttaaatataaaatcccctttctgtttaaatgccaatgtggttggaagcagaacaggtgtctcaaaagaacatatagatttaatggctgtcctccttctgatggaaacagcactaaggctagaatttgtctctcaagggtggcttcctcccaactgttgaatgcggagtttttttccttagaaatggggcatagggtctgcttgctgttagaggaacacaaaagagggagaaatctgggcattagaattttttggcgaacggccaccaagaatttttacggagaaaaatagcctatctcatgaggtggtgctgtagggtctgaaaagttatgtaaaatctgtgactctaaattttttccaggaagaagttagaaagagaggtttggggtttaacaggctgtcactgtatatgcctcccagcagtagaaaattaacttgtctcattaataaactgttcaaattcattcagcagtgctgagcttttacatgaaggaaaagcaactgaaatggagagggatgagggtattcacttggggtgaaatatcttctcatagagtgccatgaatgactgctattgcgggacaagaagcacttactaggtgaaggtttagactgaaatcttgaaatcccctggtattttgtgtgtctgattacctttccaaaggaataaaatcagatatgtatccatctcagtgagcagaggggtgactttgagtagaatgggaggaaggtttgttctaagtagtttcccgcttgcattttccccagtgatttcaggggcccagtatattttcctttcacacatctgacaagggattaataaccagaatatctacggagctcaaacaactctagagggaaaaaaaatctaataattgcatcaaaaagtgagcaaaagatttgaatagacatttctcaaaagcagacagacatatggtaaacaagcatatgaaaatgtgctcaacatcattgatcagagaaatacaaataaaaactacaatgagatattatctcaccccagttaaaatggcttttatttaaaaaacagacaataacaaatgctggtgaggaggtggagaaaagggaaccatcatacactttttgtggttatgtaaattagtacagctgctatggaaaacaatttggaggttcatcaaaaaactaaaaatagagctatgatgtgatccaggaatcccacagctaggtatatacccaaaagtaagaaaatcagtatattgaaatgataactgcactcccatgtttattccagccctgttcacaatagctaagacttggaaactacctaaatgtccatcaacatatgaatggataaagaagatgtggtacatatatacaatagagtactattcagccatggaaaaatgagatcctgtcatttgcaacaacatagatggaactgaactgtacattattatgtgacgtaaaataaaccggcccagaaagacaaacatcacatgttctcacttatttgtgggagcagcaattccaaacaatggaactcacggtcatagagagtagaaagatggttactagaggctgagaagggtggatgggaagcaagtgtgaatgttcaatgagtacaaaaaacagaagaatgaataagacctaatatttgacagcacaacagggtgactatcgtcaataacaacttaattgtacaatttaaaataactaaaagaatataattagattgtttgtaacataaaggtaaatgctcgtggtgatggataacccatttaccctgatgctattactacacattatctgcctgtatcaaaatatgacatatgccctataagtatatacacctcctaggtaccaacaacaattaaaaatttaaaaaagtgtatccttcccagtgaaccgaaatattttacattgatcatttttacattatcatagtgtgttggaataatcatagctttggaaagaaaaaaaataaatgtaaactttcaaagatggcaggagatatagatctctctttctttagtggatttaaatatgcaatttgttatcaacattgcactgacaatttttaacacaggccatattctggaaatgatatgattataggagttataggaaaaagcattttttcatactgtgattatctaggctatgaggaaaagagatatttcctctatgatgtctaatttagcataattattctttttaaactatatttagatttaattaagagatacacaaacaaattacttttagtagtaagaagagtttttaaaatgttttgtgtaagatgactatgtagtaaagaaggttacaaacctgctttttaacttagaaaaataatctcaccttcttgccccatggaaaattgaaatgttatgtggaacccaatgtacaaaaactctcagtgaggatttctgtcttaagtttcaacggattgaggtgagatcagtgcctgttccacctttttcctccctgtcctaggtgacttgataacatttatacagccataaaattttgcttttaaattcaagtatagaaaataaactttaaaatgtgatatttttatatattttaccttaataatttatatgggaaatatttttgaaaggttaaaaaattaaaatttttaaaagagtatagtgaaataatctaatcacatgtggaaattgtgttactatttccccaagcattttttgtacatgtaattgaaaatgagttgaatgtaactcataagtagtataaaagtgtttaatatttaattttctgctgcagtaatgtgacataacaaccttaaattcttggtactttaaacaagatattttttttctcccaaatttctaggttatttaagggcagttctgcttcatattgcagtttgcctgggctttactccaggctgtgtgttggagttaggtctaatctattgtatccctacacatcccacttagaaaagctaacaaatttcctttggacttcagtcagttcgattgtatttgtcattcaaaagccaaatcatttatcctaacaccaacggcttatttatttatttatttgtttgtttatttatttatgttttagaaggagtttttctcttgttgcccaggctgaggtgcaatggcgcgatcctggctcaccgcaatgtccccttcccgggtcaagggattgtcctgactcagcgtcctgagtagctgggattacaggcatgcaccaccatgcccagttaattttgtatttttagtagagatggggtttcttcgtgtggatcattctgttctagaactcccgacctcagttgatccgccagcctcaggctcccaaagtgctgggattacaggcgtaagccaccgctcccagcctaaccgattgcttcttttgttctgtagtcttttgccaaaactgttattctctggactcactttcaccttctctcacacatacatgtccctcgtgtccctttgtgtctccagggtcttctatttccacgtaatcttaatttttcatcacatcctggactcatgagtaattaatctgttattctccctgaaagtgcagccttgttgaatagaatgtgttctttaaacagcagctttgtttctcgagtgaggtattaacttccagatttaggtgaaaatgagttccaagttttatgtttcattgtgtgtctaagactgacaccgtttattaccgtggcacttacagcttgctttcaatgcctccaaattctctatctgaaaggctgggtaccatatctcatgtctgaacatagtcctcagaatcatgcagtaccagctatgttccttctgtatattatggcttccgaggtgcctgttaagcagccaggtgaaattgccttttaatcaatataggaaccagtctctttcctggtgatgctaatgctttttataaaaaggccatgctgtattgaagttcttctttcaggacaaaaccactaatggaactcatctacctactgatgggtggaagctcttggtatgccaaagtcttgttttgtttgtgaagaatctctttccctcaacagtgatgtgctacgttaggtctcaaatcattgttgcgttttaatccaaatttatgacaaagattttcagtttgtatgcataatttccttctctggccttaaccatcagtctgtggacttgccaagcaacaacaacaacaagaacaacaagtctgaggtcaagagacactatttagatctcagaatcatttgttgtcatttatcctttgataaagttttgcctttctttctttatgagtatatttcctctcatggtttcccaatctcttgagaaaaagaaagttcttgcctcttgcagtctttctcattagttgaattataccagcagttcagcttctgatcctgtcgagaaatccaccatgaagaaataaaacatttctgattacatggattacgtttcctggattcttataggcattaaacttagttctaggatacaaccgcatgatcttctcttattctcagaacaagaaatatattactatatacattacagtttgtatatattgcagtttatatagagtatatgtatatgtactgtatatatatatgtacacatatatataacagtaaaccctgtaggcaagcaggaaaacttcagaattctcaatgaatccatcattagctgttagtaatgacaacactattagaagtatttcaataatcaaacattgttgtggtctgtatgtgcacccccaaaagtaatatcttgaaattctaacacctgagggcatagtatttggaacttgggagtggaattcttttttgtgctattatgaataagatgcttgcctcttccatcaaatgaggacacagccacaagttaccctctaggagctaggaagttagtcttcaccagacacaaaatctgcttgattttgaatttagtctcctgaactgtggaaaataaatttctgcttttataagccactcagtttatgctatttggttatagtggcccaaagagagtaaaaagacacattatttacctcctttgtggactctctggagttgttgctttaaacttgctttagtgcctaacactgctccaactccctgtcctttagcacacacggataaataattctgctgggaactgacatgtttcactcaggcatccaaatgtatttattatgttgtcaaaatatatagcacttgttacaatgtttccatgttagacatattttgagatatatgccttaacactgtgctgtgattattattaatatctagtaactaatcttaccatatctaaactcaaagttttcacgataacactgccttattagggactgaattttttaaagtatgaagatcttacatcaagtccaaattgattcatctgatagtctcgcagtaaaatcaacgccacagaattatctattctgtttcttgtcttgttgtagctgatattctgtgattggacatattgctaatatctattaaccttagcataaaatgtcatattgaaattgaagaggaatattggaacttggctaagaaagattgcttttcagacacagtgagaactaaaatggaccctctgttcctggaggtatattttacaaaaattgggtgctattataggaattctgtacaattctatcttatgcacttgtgttccatcagtgtcaatcctctctgtattttaaattgactatgatttctttttccatctttctgtttgtcaagtattcttttgctgaaaatttgttattcatgttccaacagaaaatagattttttttcttttaactcattggaaagaatatttagagtctttagtgacaaatgacatggtataaatgaaaagaaaatactgacattgtacttgagaaatactaattaattgggagaatattaattaaaagacattgtttaaatatttctatcacaaattgacagcagaacaatacacaccaccagcaaggtataatagtagatatgagaggtaaaatgattaattagatattgcattttctccagaaaacttattatttagtggaaactggccaataatttcttaggccttaggataattttacctttgattctctagttaatcaaaaatatataaaaatattaaccaaaagtatatatttttaaaatacctacataatctaatgcagtatgtttcgctctcttcttgaagtgaattaaattccttatcactgaccataaaatttaactacatagatgattcttgtttaaaatagttaaaagtgaacgtaaagatcagttttggttttccttttcttacccccgttttttacacttatatttgcctgtgtcattcatatacttttagaatccaaaacaataattaaaaacataatcatttggttttcaaaagctttttgcatctctagaaagttaatatagagtcttataaaacttttagctaattcaaaaacaaatcacacatatataattgaagcaaactttgtttggtagacttcttcgaaccacagaaatttcagttatggcatggtaggtcttttgaaatgtttcattttttatatttggagatgcacaacaaaagtctttccactccaactcccctttaataaaaacagaatgtaacaaaaatatcaaaatctgtaggaaaataacccattcgtctatgttaaagctatgagatttccagcccaaataaattataagaaccagtatagaggccgggcgcgatggctcacacttgtaatcccaacacttttgggggctgaggcaggcggatcaagagttcaggagatcaggaccatcccagctaacacggtgaaaccccatctctactaaatatacaaaaaaagtaattagccaggcacagtggcgggtgcctgtagtcccactactcaggaggctgaggcaggagaatggcctcatcctgggaggtggagtttgcagtgagccgagatcacaccactgcactccagcctgggagatagagtgacactctgtctccaaaaaaaaaaaaaaaaaaagcatgtagaaatactaatacagtgaaatctggactgatatataaagaaaataaccaacagattttgtctatggcacaaaattcttagaaattttgagatctttagccttatagacctaacaaaatatttattagtttgaacagtgaggtactgggatatgctgggctttgaggctatacgcaaatctaattttagaagtcaggaactgttgtaagcaatagcaaagaatatgtttgatgatcagcttggcaattgttgaacaagcttcattcagcactgtgaggatgtaattaaagcagttgccctgcaatctattcactctcttcactggcgaatggcccaggcataagactagaaggaagatgaactggtttagtctctttgtcagctgaaattttggtgaaagagactactgatatttttctaggatgaagggatcttatctctgaaataccctttgcaggttattcctggctgaaacaaatgcacagatcctttcttcttgatcaattttgctgtcgattctcattttacattctttatttcatttattttattctttagctccagaatttttgtttgggttccattttttccatctctctgttgaacttctcatttggtttgtgttttgtttttttcaagttttagttgaattgcctatttgtcctcttgtaactcattactttcctttaaaacaattatttgacaggaaaaactgcacaaaaatagaaaaatctataaatcacatgacgaagaattcaaaataattattttaaagaatttctgaatttgcagcaaaagtttgctatagagcaacatgaaagcacagaaaagtatgaaactcattgattaaggtaaatatataaaaaatgcagaacatgctaatagtataatagtggtgtgtaaatctcttttattgctagtatgaaggttaaaataccaaagtaataataattatagctacaataatttgttaatagatacagaatattaaaaatatataatgtgacatcaaatatataaaatatggtgggctgagtaaaagtatagggttttgaatatgatcaaagttatcagtttaaaagagtttgctccaattacaagatagtatatataagcatcatgctaatcaaaaagacaaaacctatggtagatacccaaaagataaagagaaatcaaaccatgtcagtacagaaaatcatgaaatctcaaagaaagacagcaagggagaaataaagaaactaataatatgttaaaaagccaaaaaacaatgaacaaagtggcaattgtatgttcttacctatcaataattaccttgaaggtaaattcattctattctacattcaaaacccagaatggctgaatggattacaaaagaagacccatcaatatgctgcctacaagagactcacttcagcttcaaggacacatatggagtgaatgtaggggatgagaaaatttgatattccatgcaaattaaaaccagaaaacagcatggatagctatccttatatcaggcaaaatatactttaagatacaactgtagcaagtgataaagatggtcattaaataatgaaaaagtggtgagttgattaaagggatgaaacaattataaataaatatgcacttaacattgaagcacctgaaaatataaagcaaacattaatatctggagggacagatacacagcaatcaataatattagggaaataggtaaccttattgatactgttgcaattatcaatactccaattgcaacaatggatagatcatttagatagacaatctataaggaaaaaaaacattagacttgatctgcactttagaccaaacggacctaacagatgtatgttcacatttcatctacagctggagaacaggtgttcttctcaagctaacaagaaacatcctccaaaatagagcatatttgaaattacaaaatgtcttaatacatttaagaagattgaagttgtatcaagtatcttttttaaccacaatggtatataactagaaatcagcaacaggaggaaaactggaaaattcaaaaataagtgaacataatgcaatccttaacaaaaagtgttttaaaaaggaaatgaaaaggaaaataaaaaatcttgatacaaaaatgaaaacacaatactccaaaacttgtggcatgcagtaagaccgtgctaagaagaaaatttgtatgacaaacacctacattaaagaaaaaacatctcaaataatctatcattaaacctcaaggaactagataaaaagaagagcaaactaagcccaaagctaatacaagaaagcaaagaaatatcaaagcaaaataaagaaatagacagtagaaaaataatagaaattgaaagactttctgtgttcatcaatgggagaaatcaatactgtcaaaatgctattggacaaaacaatctacagataaatgtaatccctatcaaatgtccagcggcatttttcacagaaacagaaataaatactaaaatttgtatgaaattacaaaagactataagtacctaaagtgatcttgtgcaagaagaacaaacaggaggtaccacacttctcactttcaagttatattacaaaactacagcaaattttatatatactgacatgaaaacagtgacatagaagaatggaacagaatagaaagcctagaaataaacctacaccaagacggtcaaaaaatcttcaataacatgcccaaaatacctaatggagacaggatagtctcttcaataaatagcgtttagaaaaactgcaggcccacatgcaaaataatgaaatttgacagttataatatgcacaggaataaattgaacattgaaaaggaatttaaacttaacatctgaaaccaaagaatccctagaagaaaccaggggaaatcctccttaagattgaccttggcatgattttttggctatgaatctcaaaatatagacaagacaaacaaaaataaacacatggaactacaccaaagtaagaggttgctgcacagtaaaaaaaaaaataataattaattaattaattaattaattaaaaaggtcacccatggaatggtagaaaatacttgaaaacaatatatctgataatggattaatatctgaaacagataagaaactaataatcagaaaaaaatcctgattagaacatgagcaagagacctgaacagacttttttccaaggtagacttgcacatggccaacacatgaatgaagaggtgcacaaaatcactaaacaagtgggaaatataaactgaaatgaaaatgagatgtcacattacatcttttaaaatggccaatataaaaagccaaaagatagatagtgttgacaaggatgtatcaaaacgagaatgcttatagagttttggtgggaatgtaaattggtacaaccattatggaatacagcatggagggtcctcaaataattaaagacttaccatatgatgcagcaattatacttttaggtataaatttatatacctgtgggtgtgttggctcacacctgtaattccagcactttgagaagctgaggcaggcagattacatgaggtcaggagttcaagaccagagttgccaacatggcgaatccctgtctctactaaaaaccataaaaattagccaggtgtggtggtgggcacctgtaatcccagctacttgggaggctgcggcatggagaattgtttgaacctgggaagcagaggttccagtgagccgagaacttgatgccattttatataattatcctttcacagacaaaagaaatctaatcactatcttgaagagatatctgcattcctgtgttcattgcagcattattcccaaaacccaaaatatggaaacaacctaagtgttgatagatgagtagtatgtgaattgtgatatctatcatctatctatctatctatctatctatctatctatctatctatctacaatggaatatcattcagtattaaaaagaatgaaatttggccctttgtaacaaaatgaatgaccctagaggatattatgctaagtgaaataagccaggcagagaaagaaaaatactacaggtacaaccatgcaaacttgccattataagatgaataagttagggagatctaacgtacaacatggtaacaatagataataataatgtatgctttaagttcatggagtgtagatcttaagtattatcctttcccaacatgtgataactatgtgaagacatgaatatgttaattagcttgatagtgaaaatcattttaatatatacttgatgggcgcagggtgagaggagagtgagggtcaaaacactacctgctggggactatgctcactagctgggtgatgaaatcatttgtacaccaaaccccagcaacatgcaattacccacgtaacaaacctgcacatgtacctcctgaacctaaaatagaagttgagaaaagaaaaagaagatatcagtttcctatagggagctccaggtttgttccaaacagtagagagacaaacctatcaaggatgaaatatatacaagagtaggcacaacttaaacaatgtgtgtaaggcaatcaattctatataactcagcaactcctaggcttcttatcaaataaaatcactgatgtgtcataacttctaaactaaaaacaacacaaatgcccattcacagtagaatgaataaataaattacttttgcttcccacaggggaatacggcacagcaatgaaacaatgatctgctgctacacaaaatgtagatgattcttacaaacttcaactgagtgaaagaagtcagactcaaaagaatacagatagcaactttccatttatatgaaattgaggagcagggaaatccatcgtgatagagttcatgataatgatgacctttggtgagtaactggttgagaaagtgcaagagagtggttgtgggagctggaaatactccatatcttgcttgatttgagtgatgatggggatatatacacttataaaaattataatgctatatgcttaagatttatgtattttactatttgtaagatatatattagttgaaaaaatgctgcagtgtaaaggaaaccagtaaaaatatgctacctagaattgtagatttgtttaacaaaaaagcatttgagtagtctattgattattagttagcaagtttatattaagcatcattgtcctgaatactttttagtatgtaccagtaagtgtttgcctttctcaactagggctaattaaaaaaaactcaaaacctcatgttgtacacattgaatatatataattttaacttgtgaattataccaccataaaactaaaaatctaattaaaatgagttcgaataaattttagggaaaataggataatgaaaattatgagcttaagaatatgcatagataaaaaataaactgttgatagaaattttattgttatatttcagaaaatcatataaaaagctgtgctaaaagtttccagagagagagtacatagttctcctgcagtggattaaaatgagattagcattggagtactagtctaaaaccacagatagagtctggagtcagatctcagaaatacaatatatttgataagtaatgagagacaagttatttaaatttttgggacctaaacatccagtctgtaagtttgttgaaaaaaataaacaggctaaagagaccttaatttacagggagggctaaattattacctattattgtaaaacataatagcagtgacattaaaagcttgagtgctgtagaacaatatattgaaaatcactttttgaagttatatacatatttatattactttaataatttgcacaatgtaggaagaaaagcttgctttgcacaggcaacattttgccaaataatctccaaatcatcatgaattctcaattagtcagattaacaataataaaattttattgtagaggaggattattttttcattaatatatttgtacctacacatagtgtatatgtaatattttgttacctgcctggactttacaatgatcaattcaaagtatccggggtgtccataacctcaagtattatttccatatgttaagaaagtttcaagtcctttagctattttggaaaatacaatacattgctgtttatatgtagtcaccttactctgctatgaaatattagaacttatgtcttccaagtaactgtatgtttggacccattaacaaacttttctttattcctcccacccacagaaactctttccagcctctggtatctatgtattattctattctctacctccatgagatcaatatttttagctttcacgttctattcttagaataagaacatgtgatgcttgtctttctgtgcctggcttatttcacctaacacaatgacttccagttccaaccgtcttgctgtaaatgataaaatttcattcttttttatggacaaaaactcttccactgcttgtatatataccacgttgcttttattcattcatccattgatggacacaggttgatttcatatctttgctattgtgaatagtgcaataaatatgagagtgtggttaactctttgatatactcatttattttcctttggatacatagctagtaataaatagcttgcacctctggtctcagctacttgggagactaaggcaagaggattacttgagcccccgaggtttagattgcagtgagccgtgatcacaccactgcgttccagcctgggtgacagagtgagaccctctccctcctcaaaaaatccttaagaaatatgttgatgcctggttcccttattcagaattttcatttgatgtgttgagagtgtagcacagaagttggaataaacctctcaaactgattttgatgtgcaaccaaggtcgggaaccaccaaggaagagtttttatgcataaagattcctatactctatcctagaactaatacatatgaatctctgggaatggagtataagactcggatttgaaaaggtgtccttagttattctaaggactgagcagtttggatactggtttgttagagtaaaatggttaggtacctagtatcaacctagccatctaaccttatattaacaactaggaaaataaagggttggagcctctgtgtttctttgctgaaaaatctgctgctattcttagttctatgaaaacaaattcaaaattcggttattatcaccttaaaagtacaaaacctatagatattgaaaatgcaattatttttctacaggcatagttaaaatgagtttgtatatattataaatcagtttctttataagtcatttatttagataaattttgttatactgacatgattcactaattttctaaatataaatggttcagctctcagttatttttaaactaaagagctgtgttatacttattatttctaattggcttttatgatgttttaggtttcttttgaatcccgtgtccttcaagtgctttccaactttgagaagaagaaattgaccacccggactatggaactgtgcgtaacagctttgaaagtgtatttaaaaattaaatctgtatgcctttaaatcagtgaattggaaatatattacatgtattttaatgactttcctcaaatacaataaattgttttctttccaatggaatggtgtttgtattttttctttacctggtttaacacatgtaggagaacataactagatgattacatcaaattctttttaaggcaattttataatatattttatttatgattacaaaaactgccttttaaaagttcttgcctggatatgaatgcagtttcacattttttaaattgtaatcttgctttttgtaattattttatatttgtctggcttcgagttttattgggttttagttttttggaagtgggggatttatcccaatttagaaatttgtatccttgccgtaatacagtctaccatttttgttctcccagatctttcatctgtcagaacatcactcaaaggtgaaaatatttcccacataaaattattcttttcctttagtgaaattagttccagctgtatatacgtaggaaaacattcttctttttattcgattcattcctataggtacgttcctgggtctgtgattacacctttaccttagaggcactgcccaaaaagactcaagtcttgtgtaaaaatgctgttgtggatcatagcttcctaccttttacagcatcgtgaggcagggagagtaagaacattagagacaggaattagaggcatggagaaatgaaccctggagcatcccaatggtgagatataaaatagttcaagaactattaaagaagactaaggaggaatagctagaagctaaatgaagaaagtatctcaaataggaaggagtgatcaaatattttagctgtgttgatgagttaggaaagatgagtttttggattaagcactgggtagagcaacctttgggacattgacgttgaccaacttggtggatatcaggagtaagaggaggtactcaagagaatgttggagaggaatttaatatagtgagtattgaagacaacacttaaggagtcttgctttcaaggggatgtgagaaatgggttgttaatggagggtaatatagcatcaaaaagctgtttattttaagatcgatgatatagcaggtttctatgctaatgggactgattcagtagacagaaaaagcataatgcaggaaacagagggatattgatgaagacatagacctggtaaaaaaatagaaggcttggttttaaagataggcacacaaacagctaattactaacagtaggatgtacgtcagattatggaggtccagatgtttgtagttcagtagataggaggagcatgtcaaatttttgtgatattttctcagtgaaataggaagcaagctcataaaaagggaagaaatcacgaaggattaaggaaggaaaaagagatgtaaaatgaatagctaggaatgtacaaaagtaaacaaactcttggcaatctgtggtttatttaagtggtattagtcaatgtggtttcgtgttcttttccagttcagttcagcagaggcgctatcactgaataagtacagaattcagtttaactaaaggtgagatttctctaggtgaataaaacagtcagtgatgagatgttcatacatttaggagaatgattataaaagagggatatggaaagtaatctgggttaaggagtgaagtgagaaaataaagaaggttgagacagtggaaaatggtatcatcaattgtagattgcagtgtggttgacgatgcaatggagttctcgaggtaggaactagaaatttgggagatttagataagagtgggttgattgaaattggaagtattagaggataatagtatataatagtactaagtatagtatactaagtatagtagcatagtgctaagtatatactatcttgtgagtataagttttaggatgtgaagatgggggtagcatagaggcaaagtgatggaaggagatgagttaaaggaattgagaacctaggagactgaaaggattatctaaatgaattttgaaatctcaacaagagctgtgctgagtgcttgtagtcattattttatgtttactactctgtgagaagacagcacttccttttgtgagtaatggaaagttctttcatgtgtcaattgtaagatactttattaggttcaattatctttagtaatgcatactaaaaaatagtgagctcagtgggattattcagtagatatgtgagctaaccccctctgtcagacacctaagaggtagaactgatggtcttcaagaggaatagagacttctcatcctaagtgtgtaagctgtgaaatatcccaccctatgttttctgaaaacaaacgttatatagagtgtccacataaaagctaacaggaaatctcacacacacacagacacacacacacacacacacacacacaaaacattgaaaaacttcaggaaagatataccctgtacccaacatgaacgaggtcaaagcaatgaagaaaaagctaggaaatcaaataagtctagaacaactgtgactaatatataaagatttgaggtggttatatccatttaaatggtatcaattagaaaggaaaaaaagaggccaggcacagtggctcatttctgtaacgccagtactttgggaggccaacacaggcaaatcaacctgtggtcaggggttagagacaagcctggccaacacggtgagaccccgtctctactaaaaatacaaaaatatttgctggacttggtgtcgcgtgcctgtgctcccagctgcttgggaggctgaggcaggagaattgttttgacccagaaggggagattgcagtgagctgagattgcgccattgcattccagcctgggtgatggagtaacatccaaaaaaaggtattttacataagaaattttattttatttttctgtaaattataaaatagcacttaatatggaatttatataccagaatctttgaatatccaaaatttaagatgagagcaattttgagaaacttttcaaagcttaggaaaaggtaactacataaaacaccattatgtgttatttatgggtacattagatgaagtaagtcacaaaaacacgcatagaaatgatcatataaacttgcaagaaattgaatgtcttgctattgaaggaaaggttgaggtgtaagagattgaggttgagtgtgagaagctctgtatatattgtatttttcttaaaaatatatatttaaactcacatttcttgtttttcaaatgttcactccaatgaaaattcttttacttttcctgttagaatttttatttccactctcacatatgcagtgtactattgttcagaaatattagtgatcctccttgcaaatgaatactcccatcctgctgattttcagaaggtccaagtgatttgctttggctgtgaaatgtaagcagaaagagtgttattttggggacttcccgattgcaaaacaacatagtatcgcaacttttgacatagcatttacgttgcattagtcattataagtaatctgagatgatgtaaaggttatatggaaatactacattttatataaaggactcgagtagttattgctttaagtatccatggtgggtcctggaaccaattcctcatggatatggaggcacaaggaaccactgtagttaaacaaataatcactttaaaacttaaaaccttttgcatggtgagtacagtcatgcaccgcatatatgatggtggtatagttaagtttattatgccatacatttattggaagtttcctatgtttaaatgtattgagatacacagctacactgctttacagttgcctatagtattcagtaaaataacatgctttacaggtttgtagcctaggaggaataggctatgcaatctaggttaatgaagtccattctgtgatatttgcacagtggcttaattacctaagggctttgtcttcagaacatactcctgtcattaaggaatgcatgagtgtagttggacaaaaaataataatgcaggcatacctttggcactgtcctaattcttaccaacatccatgattgcttaaatttgcactggaaagacttcaaaaaacagtgatatattaggacagtatatttccaatacatgacaaatgataacaacataagaactcaaaacattcaataagaaagaacataacaattaaagcaaaactagatgggaaaaggaagaagcaaatttcaagagaaaactcaaaaggccaaaaagtgtgaaatgatgttcagccttgctagtaattgggaaaaacacaaatctctttttttttttttttttttttttgagagggagtcaccctctgtcgccaacactggagtgcattggggcgatctgggctcactgcaagctctgcctcccaagttcacaccaccattctcctgcctcagcctccaaagtagctgggactacaggggcccgccaccatgcctggttaattttttgtgtttttcgtagagacagggtttcaccatgttagccaggatggtctccatctcctgacctcgtgatctgcctgcctcaacttcccaatgttctgggattacagctgtgagccaccgtgtctggcccaaatcatttttaatctattaggcaaaaattagagctatgataatattcatttttggtgggagtgtggcaaaaggtactataacagaatgctactagagagtaaactttgatacatttgtaagggcaattttgcataatatgaaaatttaaaaatatgcttccagtttcacatacgtttatctagcatacagaattacccatgtgtaaacatgtatacagatgttcattataacacttcttataaaaacaaaatatttgcaaatattcatatgaacaagtgcatacatatgatcttagtccagttagaattttctgttttatttcaatcctttaaaagactcaacttctgattctatataaacaattcaaaaaagaatgtgttttccctatgtgcatttggtcaggtaaattaaaaaatacacctcatgctagcctcacaaaactggaataagccttgggaaagaagttgtccttgaagcttgtatctgacattgtagcaggacgagccgcagaaaaaacctctcagacactgagttgtagaaggaagggctttattcagctgggagcattagccagctactgtctctaaatctgagctcctggagtgcacaatttctgtcctttttaagggctcacaacactaaagatttcacatgaaagctttgtgattgatttgagcaagcgaggtatacatgacaaggactacttgccccggtggtcagggagaaacagaatatggaagagagtttcacaatgttcttctacacaatatctggaatctgtgaatcacatcggcttctaaatcataagtggatgttcaactactgggtttaggccaaccaggcccaggtctgtttttgggcctggcgccgggctgcctgtctttggttttatttccttgttgtttttactgaatagaaaacaatgtaaaacaagaggagagggtctttctcctctctcattttctttctttgagactttcactcatttttattagtgggagctgtcacttttatgatttatgttcttctgtgcaatagattgatagccatttatattgtatgcttgtgctgaaggcttttggtgaaataagggagagacgaagttttttatgatttggagaaacacaggtatcagacaagggagcagtaagcaggttcctattactattattacctctattataagagttttaaatcctcctattgctgggaactactttctaaacatggctcctggattgagtctgtgccagccttgcacgagtacatgtgccagttttgttatatccttaagtatatgctcaactacttgttctttatcatctatgtgtaggcaacatgtttcgtcagattctctcgccaggcaagaacagtcaaggcttgttgggttttattagtaataatttctaaagcagcttgtaaccatatgagcatgtagataggggttggatatcctcatgagccatcttgtacttaagtggcgggtccatagtattgtatgattctttcaggggtgcattcatcatctttctaaccacttatggctatgcttcattttgcctgggaagcatagactgggaagcctacaagttcaactgtttttatgggcagtaagaagaaagatggcttcatggtgccaattacacagccacacgcccactggtcaggcagcttagcataagctttgtgtctacatatctagcataacctagtgggggccgtccagtcctggtggaattctggatgggcctaaacagtctgcaactttggaaatttgctgaatgcatttctttctgtgtaattggaactgtaccatgtaactgtttttgtggcaccattatacaggttttgcctaagacaaataagccgccttacgggatgagtaaatccttttctttctctagctacgcattactgtctaataattgtgacttttagaaactaaaaattgtcggggttgttcttttgggatggaattcgtgaggaactccatctgtaggaactaattcttgggcttcttatggccattgatctcctgttacagtccttccacaaacatcacatgaaatgacttgtagagactgggctacatgtttggctaattgcaaaaacaaatttttagtttttttcagaaatttcaggtataggcacattgaattcatcatagaaagtgtgaaatacttgtcctggtgagcgtttttgaacttcttcttttatcaggatgcttacactagaatctagtccttttctatcaatgcctaatgttatatattttcttttattccactttggatctgaggggtttgtgatgatcaattttaaagggttgcagctcccacttgtgcaagaggggctgacttttcttttttggagccaaacaggatcttttttatctttcttctaagtagcctaactgacgcaataccactattgacacatcgaacataaatatggttcttgacagatgtacttattttctgtgtgtaatttttcccaaatttagagaaatgcatcttatcctctgctgtttagtattaatagtggcacgagcatcaaattttaaagttacatttgtggggactcttctttcttctgttctagctatcactttacttgtgttacttagagaaggaccagttcttagtcttacttcgaagactgtgatcatgggggtttagaggggtcatagcacacatcgggctggtcacttcctggattacatacttagtactgggtgttattatacaaacaggttctgtttggagttcttaggcattcataatagctgtaaaataaaacgatcatcttaacttgtccttcttcagtgtcctgatgtatgcactgaaggcagtcctctgtgtgggaagaggtagtggaagcttttaccacacaggtccatgttataaggacaataagtcctacgacgattttcctcatgctttggccatgtgtagtctagtcagcttcgtggtgtgattggagcagggcttgtcattttcttcaaggtcacttttcagggattgtccaagtttggtttggcctcctaggtctcagcggctgcaggcttcatgaggctgtggtgaatctaggctgggattccttctacattgacagctgtgggagtggtcaggttaattgtctggggtcctttccactgtggccacagcggagccacgttccagtccttgatccacacaatgtcacctggagaaaaagggtgaactggggagaatcagctgcctgggcacctctcatttactcaagttgagatagtctgagtaattttccctaaggcctgtagctgccgctgtaatgcaatctcacctaactcttggggagtacctggaagccctcccagtatgggaggaggcctatgatacagaatttcaaagggggagtatgctgttctcttagaaggggtacacttaattttaaacaatactataggaaggacttgtgtctattttaaatttgtttcttgacatactttccagaaactttttctgatagttcgattcatttgctgcactttccggaactctaaggttggtaaacggcatgtaacttctatgaaattcttaatacctttgccgtcttctgtatcaagtcagcaacaaatgctggcctattatttgagccaattcgtagaggcagtccaaacctagggatgaaattttgaagaagtacacaggttacttcaggagctttttcagttcatgttggataagcctccacctacttagagtaagtaaacactagaaccagtaaatacttgttacttctacatttaggcatttctgtgaagtccacttgaagatcttcaaaatgagctgctccagaggcttctattccccgaggtacagaggggccttgcttcgcattgtgctgtccacaggtaaggcatcactgcgctactgttgtagcaacagctggcaagggtgagatgtagaaatactggcctaacagcttttcaagtgattcttggcctcaatgggtagtttcacatacagtcagcatgactgtatagcagcggtggcactgctattcttccatctggtaactttatgtatctttcctttattgtttgtcctctctctgtctgaaaaaattctttttcctctttagaataagttggcaccagatcaagcatttgaaggagtagcagggctgtgactgatgtctggtaaggagtagatgctgcttttcctgcctctgtgtctgctcagggctttccttggcaaaccgaagcggaaactcgctgatatcccctgcaatgcatgaatgccaccttttggggtttctacactgcttctaatcattgtagaatttcttgctgacattttatgtcttttcctctagaattttttccttatacaatgctccacatacttgaagggttagaaaggcatatcaagaatcagtatagatgtttacaatcttaggttcactgagttccagagcccgagttagaggaatgagttctgctttttgggctgaagtgctctgaggcaatggcttagcttcaacaacatcatctaagtttactactgcatatcctgcacacctttctctttgcgggttgatgaagctgcttctgtccatgtagaactcctaatctaccaatgcctatggctggtctcaaagatctggtctgctagaatagacatagtccaacacctctacacagttatgtttaacagggctgtctgatactgggagcaaagtggcaggatttaaagaattacagacttctatggttatacattgattttcacataacaagctttggtgtttagttaatgtagcatttgttagccaatggtgtcttttggtgttccttagagttacattagagtcagcttgggctgacataagtttttcttttaacttataagtcttgttgttgtagagacctctatttaaaaggctctcggtcaccccctttataactccattcaatgctttggctaacaccacaaagtttggaatctgcagtctgcaaaaatctcacagctcctaaatgttctcttatttgcctcctggttttaggttctggtaagctgcagatgacctgctttcttgctgaccatagactgcactccccttttcaaatagtgaatcctaggtagtgtacctgctgtctgcagatctgagctttctttttgggcactttatatccacagtcctccaggtgtcgaagcagggcacccgtcctttttgcacacctgactgccatggagtgtcctagcagaaggtcatctacatactggagcaggatgcaacctaggtctttagcaggaaacatttggaggtctccaaccgaggcctccccaaagatggtgggggactttttgaacctttgggaaagtcgagtctaagtgtactgaatggtgacatctgactccggatcttcctactgaaaggcaaacagcttttggctctcaggaactagcctgatgtgaagaaggcatctttcaagtcctgtacgggtcgatagtctttggtccttggtttagggacaggtaggaggtgggtgttccatggagactggcaaggaactagaattccagaggcttttaagcatataagatgagtctctattcctttaaaggcttccctgggaacaggatacggcttttgtccaattggctaggtcgtaggctaaacttctatgagtacgggggcttgattgattgccagcctcagaggattgtcctccatctctactcagagccgtcactcagctggagccacttttatttcctgagctggctcagttagcaaaagtctccactcttcttcctgggggactggaagggccatgatgactcctgtttctggcaactccagctgtaaagtgccttgttttgtcaaggaaatggtggctcttaacttgctaagcaagtctcttctcaacaaaggcaagggacagtcagacatatacagaaatggataaatcactttgtgtcctcccactgagcagttgcgcggtagacagaagtcctgcttggtagagactcctgttgctctaattctatcaatggtctttatagatgagggggccactggagtgcttactactgagtgttcggctcttgtatccactaaaaacttaatgtccttgccccttattgtcatcctgaccatgggctccttgggggcatttgagcctgttccccttaattctagcagcccctcagctagattgaacaaaatcctttcatcttggtttgaggtctttggctctgcatcactctgattttctttgagttggggacatttatctttctaatgtcctatttctttacagtaggcacattagtcatgctgcaaatgtgagtgattggacagggcattcctcccagaacccccttttttctgccttttcaggagaattcctctaattgtcacagccagcaaactagcgtttcacctggcctggcgttcgccctccttacggctttcttggccgcttgttgcatctctatttacaaatacttcattagctctttccagtaactgcaaggttttcattcctgcaaacctagcctgtttttgcaattttctctggatatcttctgcactctgaataactaaggccgtattaatcaacggctgattttcaggactctccagatcgaaaggagtgtacatgcaataggcctcacacggtctttgatagaactgggctgggctttcctcctttccttggatgacttcagaaactttatttacattggtacccttttgagccccttttttcaacctttcaattaatgcctctcggtaccctcttagcctttccatatctggtccttcatttggatcctattgagggtccgttcctggcagctgaattcttatgtattcttggggactttgataattggctgggatgtgctcctccagccatttaactgttgcctgcagcacctgttgccttttatgtgttttaaagaggtacatgagtagctggtggcaatcagcctaagtaggattctgagtctggataattctttgaagcaagtcaattagggcttgaggcttttcagtgtaagatggagtgttatttttccagttgagtagttcagcagaggtaaaagggtgatacacaaaagcatgcctttctaccgtatgtctgacctcatctgtcctagtatatcgctgctctctcagggcatttgaattcccgtcttgggccgttaagcgggctgccagggaagtggattttcccgcagtttcacttttgttcttgtctactctgggtggtctaggggctgtgggctcaggagaagggggcctccccactggataaggggttgagggcactgttggtgccatctcctgccttgagtcctcgagctctgggtcaaacagaactttaggtgctggcttctcttggccggtggagcgagaactttcctgaaataaatgtccctttgctactactactgctgctgcctgtccttttaccactgtagaggatctaaaactagctgtaactaggaatctctatatggaaattgatatgggtgcaggcacaccatgagcgatcaggccaagcttccgctcaggtggagtggggcaagttgaaaagacttgtcttactaagtttcagatgtctggactccaagtgccagttccttcctggtgttcagccactgtgttaatcctccgcggggatcactgctctggcgaggcgttcaaccggggccatttcctacctgggagcgctctttggatcccatccctcaggctggccagagtccctggcagcctgagggatgccccggccttactccacaaggcatgcctaatctgcctaaggagctgcctcggccgtccatcagttatcttgcttccaggtcagggaaccaagaaatgtagcaggacaagcggcagacaaaactctcagacaccgagttgtagaaggaagggtgttattcacctgggagcatcggatagctactgtctcaaaatccgagctccccaagtgcacaatttctgtcccttttaagggcacacaacactaaagatgtcacatgaaagggtcgtgattgatttgaacaagccagggatatgcgacaaggactacatgcacccgtggtcagggagaaacagaatatggaagggagtttcacaatgttcttctatacaatgtctggaatctatgaataacatcggcttctaaatcataagttgatttgtaactactgggtttaggccaaccaggcccaggcctggttttgtgcctttgattttgcttccttgttgtttttactgaatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaatagctaagtgtgtttcttttcttacatatacagtaatagttacatatcattaattttaaataaaagctctaattagtaaaaagaggtttaagacacttgatagtatgaaatacaattccaggttacacataagttatttattttggcaaaaggatgactcaaaaattttaaaactaggcaacaatctttactcattaagaggtaagacttagctttccaaacagtttgtctcctgtctactcttttctctccttggcattctaccaacaaggcaaaccaaatatttcattattcttctctattacatgaaaaatctgtacaagggaaggaaagccaaattttacccttacataggtttcaaaagaatcctttttccataggcaacatttacatttttatgcctttttataatcttttaccacaaacacatttaagtgttcctacacaccttgcatgtaaatttatttttagttgtcttatttacatatttttatggtcaatcttagcaatttttaactttaatgtaaacctggtaagttgttttaattatgtactagatgcagataaagtctgactttttccattctagttagggcatggttaatttcatatgtccccaggccttaccaagttgtaaagtaggcagcctacaaccttgaaatatttagcaagccttttatctaatttatgtgatttaaacctgctatttacatattgatgatatttgcattttccaatttgatctttaaaacagtttttatttcttagagtttaaaaacacataaactaaaaggcattacggttttaactttcctctaaaatatttgatttaagtgcttatttttatttaaggcaatcaattggtcctcgttacagacatcacacacaacacatatattgctacacagacaaacagaagaagatccagtagctctaagatttcttctcgtcccatttcctaattgcattactggcttcccagtagagccctttaagaacagggatagcaaaccacgaagtttctagggcctaatcaacttgtatagctgtaagacaaaaacagattttgagcaggattgatcagcctctagattctgggattccatgaggaaaacagaggtttctcccaaaatggaatccatcatgcattttctgtttttcccaaaacgtttcaggccaccagaagttatcttgtgtgcattaagagtggaaagacagagtggagaacagtaattcagtcaatggaaaagttcttttcaagaaaaacacgatccaagaagacaaaaacatgcaggtcttttaaatatacctataacttgaatatccacttttaatcaagctcagcaccctttcagaaaatcctttgacatcttctgtttcctgactttagctaaatcaagcaggtaatatttctggcttttgaattttaccaaaggtaacatcacaggggaaactaaaaactctccgttaggttataagttcaccgttagtatacaagatattttataagtggtggtaagcagcttttaccagatctagaacctttaaagtcagttgagagaaaggaagatttcagaaaggcagttagagtttttcatggcggagcacgagatgattaaacgtcacacagttgttaactggaaagtattcatcacccaggctgggattgaacctgggtcaccattgtaaaaaggcaacggctgaaaagtggtactaccacatggttacaggttatgcttaaggacataaaacaagtcggagacatgcagcaaagtttgttactgaccagtttatgagggtgtcttgaacagtgagctcaaggagtctcaggcctggattccattccaaggtaccctctgtctgactttttcttctattttctctccttttcctgagcctcctcctagtacgtcttatgaaagactgaggtggctactcttagaaggttttctaaggtgccttctagtcctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagagttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatattgattaaaaatcttaaatcaatatttgaaagttcttaaatatggatttgagtttcttaaagtagtcaaacttgttaacttctgtccctaagagatctaaattcctattttaaatgaaattcaattagctacatgtctacaagaaaaggcatatattactcttttattcagatcactctcgtaaaaaaattacctgagtagcatcattgtagttctcgatatctccacttccagttttacatttaccatcattgaaatcccatccagaatatgggactgctggaaagtccctacttccagggttgaagtaacttccacaggtactgcttgttcctgcactcacagcgttaccacacatatgattaattacagcatccacataaatacgaacctagaaaacaaagtttctacttcagtgtgacttacagagaggtagaaatttaaagcattattgatgcaagtttatagtatgttaataaaactccaaaatatttcatg

SEQ ID NO: 526 - DNA, 179642 bp, Homo sapiens
  misc_feature (10961)..(60960): n is a, c, g, or t
gaggtcaaccagcaagtatattactgatatcatgagactatatggcataaatgctgcagggccctcaaaaggacaactaaggtgacccatatatttggttgcctgccttgataggacatcaacagcaaagagagaactacttttcccagtggattctaaagcagaaagaaaaagagatgaagaaaatgaaagaaaagactacgtcaccttccccaccataggttccctgagcttagagaagggtgtatatttagaagtgagattagtattaaaaactgaactgaaagtgaatcttaattataaataatagattgtttttaaaatcaaaataaataggaatgctaagggtgactgcagagaagggagatccaataaagcatgttgaaattgtaaaatagtttgttttgttttctgattttcttttggtagccccattaggtccagctaattcaacctttcagcatctgtatgtagatgcttttatttctataagatagatttgaaaagcagaattactggatcaaaaagtatggtaacatttatccaaataaatatgaagatttacttttctaaatgcctgtgacaaacatttgccctcatgcacacacctacattaaattttatagctatgtataatgttttccagtttgagaactgagaattggtatattcttgtggggtctaattggcattcccattaccaatagtaaggttaaacacctttccatatgttaatgggccattcaggtttcctttttgtaaaatcacctgtttatattctttaaacacatttttctattaatttgtctttctttttccaattttttggtaccagctgtattttctgacgtttttacgtaagagaagataatctagcattgtcacattacagaaaaacaactacttatgacagtaccatttatcaggtgaaacattttctctaggcatcttctgaaatgtttagtacattttaattttttgattgactaatgtattagtctgttttcatgctgctgataaagacatacctgatactgggaagaaaaagaggtttaatggacttacagttccacatagctggggaggctccacaatcatagtggaaagcaaggagcaggtcacatcttacatgaatagcagtagccaaagcgagagtgctagtgcagggaaacttttttaaaaaccatcagatctcatgagacttattcactatcacaagaacagcatgggaaagactcgcctccatgattcctttacctcccaccgggttcctctcacaaaatgtgggaattgtgggagttacaattcaagatgagatttgggtgaggacacagacaaaccatatcaactaatacttaaatgtataggtttatattaagaaaaatagccttccaggttgcatacattaaaaaaaatgtgccatccaaatggattccaaattgtaaatggagttaagaaagtattttagaacaggaatatttttcgggtgctatttccctatcttctctagattccatcccagaacagaagacataagcaagctataccccataagaaaaggctaattacccctgcaatagccaaaagttcacataaatcctgcctctgttcatttgttatttaaaggcagagactaagtctacaaataactatgtgtgagatccacacataatctaatctatcaataaataacaaaaataatattgacattttaactttctgatcattttgcatagaaatctttagacaggtttcctaaagtcatcatgcaaaccactgaatatgtaatccctggttgtcagcagtgttttttattttcttgataataacattaatttattcactgataaatgttttaaaacatatgtcaaatattcactaatatatattttaacattcaatgatcattaatctatttgtaaggtactatgttaatgcttggaagatatacagacgaatatagaaattcctgtcttcaaggagcttattagtaataatgaaattatgtacataattatttataataaaatatatttatgataattttataacagaggtgaaaagttctacaataacaaatgggatgaagacatgaattctaccttgggaaaaaagaaaagactttgatgatgtttgttttaagttactaagtaattggatggcttattacacagtgacaaccaaaacactgaaaaatctagtgttcaggttttttgttgttgttgttgttattgttgtttttgtttcctttgccagtatgggaagagaatagaggaggcagagatggtgttgactgacaatgaagaatttaatgagaaagtcatatgtaagcatctgaagaaagtcagggagctaagcatgcagatatctgtaggaacagcatccctgaaagagagaatggtaaaggcaaaggtcttagttatgggtctgaagtgttcaagcacagccagaaggtcagtgtatttatagcagagggaaagaagaggggaagaatagatgaagtcataaaaataatatactggaggagttagatcatgtaaattctcacagatcaaaataacttcagcatttactctaagtgagggggaaagctactgcagagttttgaagatttaacagaatcactctagctgctgtgataaaaatatattgaagaagcaatatatttttaatcatgttaaaatggacttttcatggtaaaaactagtcctaagctatcaatacctttaagagaaaaaagttatttactacttatgcaaagtttggtgggagggaagttattctgtaggggagctgtcattgatgtggtgagttggtactctaggctatgtttagcttgaggttctatcacctcaatatgtggcctacatgatcactgttttcatacccaatcttccatgcaatactctggaattgacacatgttgctttcattaacaccccatctaccaaaatgaatcacatagtcccaactaacaacaagagagttgggaaatggaaaggaatatatgaaataattgttgagtcttactgtgtcgtccagacagaaagggcaaaagtaggagactagccatgaggctatgacaatattccagatagatcatggctgcttggacaaggatggtagaaacagtgggaacagtgaaaaatagtcaaattttgaatataatttgaaggtaagataaagggaatttgctgaatgtcaaggcatgagatataaaagatataaaggagtcacaggtaactgagatgggaaaaactgaaagaaaagttttgaatactatcaagagctcagttttaggcctgttagttttgagatgcttattacacaacattgagaaaatgtcaagtaagcagttcaatatatggattgggagtttagagaagaggttcaggctgaagatatgatttggtagtcatcaatgtgtggttcttaaagccataaaactgaatgagatgacttgtccagtacaagtagggcaaaatgagaaaagattgagcatgggaaactccagcctttggaggtcaaggagatgaagagcaatcagcaaaagaaacaaagagagtgatcagaatgataggagaaaaacttggcaagtttggtgttcagcaagccaaatgaagggagtttggtttattggttgtttgtagggtgttttttgtttgactgtttttagagcagagtaaacaactgtgtttggtgagcaatgcttatagatcaagtaggataagatctaagaaattaccactggatttagcaatgtgtagaggtcactgatgacctcgagaagggcaatttcagaaaaacaattgggatacaaatctgattggaatattctaaacagaatatgggagaagaaaattggagacaacaaatataaaccaccatttccaagagttctgctattaacagaaagaaatggaatggtagccaaagaggaaagtggaaagaagagagtttttaaaaattattttatttgcttttggcttttttaaacaaaagggtaaataattgcatttgtatacactgatgagaaaggctcagtaaagtacatgagaaggcaggagatttacttcccgagagaggttagcttaaccaagactcacagatacagttaggattaataggtatgggaatcctctataacttggttcactttttttccccaaatgagattaagaagcaaggtcaccatctaagaatgaaagtgggaaggattcaaggtgacaggaaataggagaaagcatggagtcaaagatttactagagtaaggcaatgagagaaagtgagatcgaacagtaggagaagtggtgtgttttggaaaccaagggaagatagcgtctcaacgaagaagtggtcaagtatgccaagcattgctgagaagctaaaatgagaactgaaaaggcctattagatttagtaactgggaggtaactagtgaccctaagaagaactaccttgtggactgatgggatcagaagtcaggagcacactttggagtgaatgggagatgaagaaataagaataattatgtctctctctttagaagcttggctatgaagggtgaggggaatgcttttggctagaagccaggacaaatattgggatcaacccttctccctattgtagttctccaaagcatgccagagataggacccagcagttttcctgtcttcatgcggaaaaatggggagtttgggggtaaaagggaagatgtaatagggaagtacaagtagccatgtggtcaagtgaggaaaactagggacataaaccaaaggaagcaaaaaaggtaattctgtctgagaaggtactcagtaacatggaggaactgatgaagatgaaaattaacccaagaaaaccaccacattagcggggacctccatcaacacacaaaacccctgagaataagaatgagataaagaaccaacaattgctcagtgaagtcagacactcccaagctccactacttttcccgcctcccattccccaacatagaaaatcaagactgaaaatgagttaaattcacagttctcaaactgtgctaaggtgccccaggtacccttgccaccttatagaggtactataggatattttaaatatttgagggaaacatagcaatactcactgtttaccagacactacctgaactaccagcttgagatgtttctcaatttgaacattagatactgtttaattccttttaagaatgtcatatatttgaaaagctgggtttttggctgttgctctcatataaaacaagtgcttcctggaaaaccagagtggaataggaaataaggtggcatcaaggggtgctagaaaaaactgctgggacaataaagctaccaataactgaaaaagtttggcaacttctgggctagacaaagaggagggaatgagaaaggtacttctcagatacgaccacacatacctacactcagacacagaaaagattagagtgtattacatattcctgcaatcctttaggtcaagcctgatatgaggggagtgtaagaagagacaccttaatggagtttggacttgacatctctaaccaactgtactgatagcaactgaaagtgactagaaaattatgacctctacctgagatattgtcaaggaaaggataaggtagatttcattgagtacaactaaaagcaattaagtagagagaaaataaaattctgtcatgtaactattccactcagtcatgatacctgaattacagtagataatgaccattaaactctgcctgatagcccctgtagtaattcctaaccgtaggaggcagtggtaaatataaaagtgaattccttcatgcattcattcattgaatagatatttacagaatgtgcactatgtctggaacattttactaaacataagagtcacagggaggatgtgacggtcattttgcatgacacctgtcaccaactgatcccaacagttgatttggctgatctggctaactagctgggttccccttccttcctaactgccccatatatgtctcttccaaagctgcccactcggctgaggaggatgacttacccccataaaggaggatgatttttctgtaagggcatacgtgtagcagtgctcccttgctagaagctccaaacaagtcttcaaagaacacacacaaaaaagccgctgaaggatagtgtttaaaatagcatgaccactccaatcggtttataacactaccctattttttccaaagcacttattattctctgaaaagaactttatttacatatttattctgtcttgattttagaaagtaagcattgagagggcaggaattgattgtcttcttcttcttccttgcctcaacttctcaacatctgcatgtcccatgactccattatgggcacaattctatctataccctttgtcattcttcagatataaataccatataggttgatgccatacctcgtggtaacctttcccaagaatgccaaacacacacattcaacttcctacttgaaacagggatactgaatagataccttaaacttaatatatgttcctctattcccaatgtcccactacagtttctaacctagctatacttggtcaatcttctcacattcagtaaatggcatcatcatctacagatggataatatctagcttaagccaaaaatccagaatttatccttgcttactattcttcatctgcaagttcctatcaactacttctaaaacgtatctcaattccagttccttctctacatgtccactttcaccaaactattatggtagtgtttttctccagacttctacagtagtccaactggtctttctgcttctgttttttgcattgcaaccggagaaattttcatacctaaactttgattctctcccctcaacacacacctacttaaagaatttgtcagtttctaaatgttcctcaaataaaaagggctcctaacaaatctacagcgtctacgtggtctggctctacctatctgatattttggtgggtgtgtggggaaggttcttctcatgtttgtcttctagttttcattaatatctgtctctctccttttccccaaccaatgcgggatgacagcagattgctggtatactgcttactgctgtatctctaacatttatttaagtggcaaaaagaactgtaagaggaactctggttctccagactgtagcagctacatctagcataaaacctctctttagaatcctcaaggccctctctgtatggggtgaggggtacattcctgaccctccggggatgatccctgcctcactccattcagaatctaggcagaacagtggattagaatgtagacccccagtcagaacaccaagggtcaaaacttagttcttccactttctagctgtgtgatttaacctctttgtacatcagtgtcctcagctgtaaaatagggagaaaagtacctacacctacacacacacacacatacacacacacacacacacacacccctacacacacacacatacacacacatgcaataatttatttattaggttacctctccctagaggctgccatttctgcgaaatgaaccctggcaggggcctatccgtctgctaaatgcctactgattcaagaaaaaagtctgaactctcaacgttttgccccttaaactgagttctcctccctacaatggtgtctaatgagttgacagaataactggctagctttatattttaccatctaaatactgtaagaacatacccggtatttccacacccaagttctcctccttgctattcaggccaattcactttcccaaggccagggattaagagccgcacggtcagctccagatagcgctcgccgccgtgcgccccgccccgccgtgcgccccgccccgccgtgcgccccgccccgccgtgcgccccgccccgccgtgcgccccgccccgccgtgcgccccgccccgccgtgcgccccgccccgccgtgcgccccgccccgccgtgcgccccgccccgccgtgcgccccgccccgccctgtgacggtcccagcccgcacatgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactggtaagggcgcgcccctccggagtctcccgggaaggcatttgggaagtgaccggggagggggagcgctgacaagagtaaaatggaaacgagtggggaagatggacttgtgtgatgagagctcccccatcctacctcttttttatcaaaatatctgctctgcgaagtggagttttaatcggctcgagtctggattagtcatagcactgcagaaaagggcaagtgagaacgacaaagcagaagaatggaaattagcttagttatattgagttttcggatccatcctgagagcctcacaacttttttgaatttggggttatttctcctggactcaagagtattcttacaaatgtgcatcaagggattttttaaagtcctacttcatttataagccaatgttaaatcgttcattaaaatagaggagaagctacattggtgacttgcgtaaattaaatgcagaatttcaactagaaaaagaggcttttcataaaaatttcccgatgacatcttttagggaacaattttttagggctgttaagagtacctgtgtaggaatttacacaattactttgttttgctttatatccaaagatattttagatttctcttcattaaaataggaatagcgatggtgcaagactcagtggttttaaagtttccctaggtgattttaatgttaatgtgcagcccaagttgagagttactgaattagaagaaagaccaattttgatcagtttaaatgtcacttatgcctgcaaattaaaaaaaaaaaattatatatggctcaatttaagtacatcaggtcatcgtgtatcagattagacaaaattagaatgtgcgatataattattaaagtaacttttaataagcattgaccagagctcttccttagcatagtgattcttttactgttgatttgtgtttcttttctgatggtttttaaaatccgtataatttatgtttaaaaatagacttctcccattgaacattattacaaagataaagcacaaaggaaatatgcaccttgaagaacgatttctctgttggtgaatgtttttaaactacgcattgttatgtatagaggaaagtttaaaatctttagatctgtcataaatgaaggaaataaatttttagttggttaaaagtgaccctctgtgtagaacaggtctttaaacttttggtcttttgaactatttgcatgtgtaaaacgtgtgtctttatatgatagaggttgcatagctttcatctcaagtctgactcaaaaagtattgaaaaccactggactgaaattagtaatcagttaaatggtcttgagttttcatcctttcccgtgattttattaacatgtcacattactccactggtaaaaagtcagatttctttgtgagaaactgaaattatattggaagtaatttgtaccttaactctgtttcagaaacatacagcttttgccacattccctaatgaaaaagcagctataaaggtatgactttttcttgacgattaaagttgtcaacaggatcctcttatacaatcttggttcagataatgtttaactgtggtttttaagaagcaaaagcgtttgtattccaacagtttccccaacagactacatttgatttgtcagttggcagatcttgcccagtcctttagtagattatctataaagaaaaactaactgcgtatgtaattaaaataacaatttctaaatgatttagattgataaatatctctgtgactgttacaaggtaagatgtttcaagtgttaaaaggagaatatacatttctttataatgccagggaatcattcacaggaggtgatcttttagctagaagtctaatgattaattggattttttcagaaggaaacaagtggagatgggccttctgggcttgcagaacaccaaataaagctgtgagacattggaagttataagtggagcaggagctaagggttgagatggaaatggaacttgaaaaatagatttgagtctgggagagaggtattgagtttggtttagtaggtggacacttgatacttttgagctggctcataatatgatcaggcctgttaaagatatctggtatagttcatatcatggattggatgtgcagaattattagaggtaggagaccaaatggaaggctgttataatggccaaggcaagaataactatctgaagaagacagtaagaagacaaagggggaagtaaatatatattcaatagagattgagtttgtaggttttataatataggggttgagagagaatagttcaggatatttagattgaggattgagttatttgggttgttatattagctgacatgaggatccagaggatgtttgcaaaggcataggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcactatattaggaatttaaaaatttggtttgtgtttctgactttagatcttagctatctgctttgaagagtcactcactgtctctggacatcacctgtaaaattatggttttaattagataatcattgaggttcctttctactccgaagttctgtaattgcttataataatataatgaactctaggccaggtgtggtggttcatgcctgtaatcctagcacattgggaggccgaagcgggggggatcacttgaggtcaggagttcaagaccagcctggcctatatagtgaaaccccatctctactaaaaatacaaaaattagccaagcatggcggtagacggctgtaatcccagctacccggggggctgaggcaggagaatcgcttaaacccaggaggtggaggttgcactgagccaagatcacgccactgcactccagcctgggcaaccaagcaggactctgtctcaaaaataataataatcataataataataatataatgaattctataattgcttataactggctgttaatcctttctatttttccattcttggttatgtagtagtagttgtttttttaatcacttgagcagatagtgccagattgtaaggaacttaaaaaattgagataaatagtaatttaagaagtttgcagccagtgcggtggtccacgcctgtaatcccagcactttgggaggccgaggcgggcagatcacgaggtcacgaggtcaggagatcgagaccatcctgactaacacggtgaaaccccatctctactaaaaatacaaaaaattagccaggcgtggtggcggacacctggagccccagctacttgggaagctgaggtaggagaatggcgtgaacctgggagatggagcttgcagtgagcggagatcatgccactgcactccagcctgggtgacagagtgagactctgtctcaaaaaaaaaaaaaaaaaaaagaagtttggttttctagttgctaatagtataatttttaaatcacatacttttatgatagttgagaatagttaaaagtatatcttaaacaaatactacctacttgtagaatcaattttagtgcagaacatgaaatatatttttagaaaactgaataattgacgtgcctatcaaatagtgtagtcacttttatttgaaatagcaaaatgttagattattcaacacattttcattcacattgaaactgacattctttgaatcaaaactgtttcttccttctaggtttgatatacgtttgatgaaagaaggtcgtatgaaaggacaagctttcattggacttcctaatgaaaaagcagcagcaaaagccttaaaggaagctaatggatatgtgctttttggaaaacccatggtggttgtatcctttaaatccatctatttcaaaactatataatttttagaaggatataactgaaattaattttcatgttaccctttagaaatttccacaattggcattctagcagtagatattcattcgttacaattaaacccaccttactgagtcagatgacagtgttatttagatttttaataaaagagcttcagcagcatgaggttgttcaatttcagccaagtttaaatgtttcacttatgcagctcaaaagtacataggcatgctaagagactagagtatccagaagtacatttggagtcataaaagaactaattcattttatcattttattgtaatttatatttctacatgagaattttaataactagagtatatcattgattaaccatcttgcttttagtagtcaatgcagtttgcaaactagaaatcagcaagataggtaaagaagcaaaggcccaggtataaaaaataatgactgtaaaggaaaagttaattattaatttcctctcaagtcatgaagagaggcaggaggcactcaaggtaaattaaaaaaccatactcccaccatacactagaaagtttttgagaattatttagaaaagattacttgcatattcatgaaggaaaccttaattttaaattattagcagtttgctcgatctgctagaccaaaacaagatcctaaggaaggaaaaagaaagtgttaaaaattaataaaggtaagtgtgaataaaacataataaaaagacaagactaattcttgagataaaattaagaataaaagtttgacaaggtagtaattcaggtatctctttttttttttttttgaggaaatacctatctgtgcagttaagtcccattaaacgtcaaaactataactacagattaaaacccatttatatgtgaaaattaagtttggagaatgaatcttataaggggagtgtgcctgttactctttttttaactttttctgcctatagtaaagcaatggttcttaaaccctaatatgtatcatatcacttggagagcctaataaaacacagattcgtaggttccttccttccctgaaagagttgatttggtaggtctgatgtggggacctagggaaactgtttataccagttttccttttaatgaggggatttccaggatgctggacatttagtgctgaaatggggaatgtgtctggtaagccaagacaggtcggtcacccttgttggcacctgaaaatttgcgagattaatgaggtttcaggtaatgatgaggcatcttatccagagaccacagcttgaaaactcctggaataaacacttacagatacattttctaactcttaaaattaacctaaagtaaatgttaaaataaaagttaaaaaaaaaagtcaaactgtcattaaaaataattctggctgagcacggtggctcacccctgtaatctcagcaatttgggaagtggaggtgggcggatcacaaggtccagagatcaagaccatcctggccaacatggtgaaaccgactctctactaaaaatacaaaaattagctgggtgtggtggcgcctacctgtagtcccagctacgtgggcggctgaggcaggagaatcgcctgaacctgcgaggtggaggttgcagtgagccgagatcaagatcacgccactgcactccacactggcaacagagcaagactccatctcaaaaaaaaaaaaaatctacagtgctgagtatataaaattattaacacatttcacaacaatatgtgtttgtggagttaaatattttttgtctttaaaacaggtaattttagtgcatacttaatttgatgattaaatatggtagaattaagcattttaaatgttaatgtttgttacattgttcaagaaataagtagaaatatattcctttgttttttatttaaatttttgttcctctgtaaactaaaagaacacgaagtaattggtcacaattactggtgtttaactgccaaatatgggtaaataagggaaaattttgtttaatatttagtccttctgagatggcttgaatatttgaattttgttgtacgtctatactgggtagtcacaagtcttataaacactttagaggaaagatggatttcagtctgtatttttaaacatcatttattttaaatctggtgctgaaaaataagaaaaaaattaaactgcattctgctgttcttctttagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaatagtgtttgtattttttctttatctggtttaacacatctaggaaaacataatattataaaaaatatatataatttgtaatataatttttttatgattacaaatactgccttttaaaaattcttacctggataccaaagcactttcacattttttttattgtaatcttgttttttgtaattattttatatttgtctggctttgagttttactgggcttttggttttttggaaatgggggtttatcccaatttagaaatttgtatccttgctgtaatacagtcttccatttttgttcccccaaatctttcatctgtcagaacgtcactcaaaggtgaaaatatttcccacataaaattattctgttcctttaatgaaatgagtttcagctgtatatacgtaggaaaacattcttttttgtcaacttgacgttgacaaacttggtggatgtcaggagtaagggtattcaagagaattttgaagaagaatttaatatagtgagtatcgaagacaactcttaaagagtcttgcgttcaaggggttgtgagaaatgggttgttaatggagggcaatgtagtatcaaaaagctgtttaagattgatgatatagcaggtttgtatgctaatcagactgattcagtagagagaaaaaacataatgccggaaagagagggatattgctgaagccatagacctggtatacaaatagaagggttcgttttaaagataggcacacaaacagctcattagtaacggtaggatgaagggcagattatggagttctagatgtcggtagttcagtaaataggagcatgtcaaatttttgttatattttctcagagaaataggaaacaaggtcataaagagggaggaagtcatgaaggattaaggaaggaaaaggagatgtaaaatgggtatccaggaatgtaggaaagtaaacatactcttaggcaatctgtggtttatttaagtggtatcagtcaatgtggttttgtgtttttctccagttgagttcagcataggtgctatcactgaaaaagtacagaattcaatttaactaaagttgagatttccctaggtgaataagacagtgatgagatgttgttacatttaagagaaagataataaaagagagatatggaaagtaatctgggttaaggagtgaagtgagaaaataaagaaggttgagacagtggaaaatggtatcatcaattgtagattgcagtgtggttgaagatgcattggagttcttgaggtacaaactagaaatttgggagatttaaataagagtggggtggctgaaattgaaattagagtataataatatataatagtactaagtatagtatactaagtatagtataatagtactaagtatagtatactaagtatagtataatagtactaagtatatagtacttagtgattataagttttaggatgtgaggatgggagtagcatagaggcaaggtgatggaaggagatgaattcaagaaattgggaacctaggagattgaaagcattatctaaatgaattttgaaatctcaacaagaactgtgctgagtgctttttgtaattattttatctttactaccctgtgagaagacagcacttccttttgtgagtaatggaaagctctttaatgtgtcaactgtaagatactttattacatttaattatctttagtaattcatgctaacaaataatgacctcagtaggattattcagtagatatgtgagctaaccccctgtgtcagacacctaagagatacaactgatgattttcaagaagaatagagttctcatcccaagtacttaagctgcaaaatgtcccaccctatattttctgaaaacaaacggtatatagagcgtccatttaaaagctaataggaaatcttaaagcgtgcgcgcgcgcacacacacacacacacacacatacatacatacatacatacacacaaaacattgaataagcatcaggaaatatataccctgtacccaacatgcacaaggtctaagcaatgaagaaaaagccaggatatcaagtaagactggaacatctgtgactaatatataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatgattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaacaatagccaagtgtgtttcttttcttacatatacagtaatacttatatttcattaatttttagtaaaagctctaattagtaatcaacttgtaaaattcacaaaaaaaccaatagtattaaaatcccacttaattgttgaataagtgtaagataataatagtcagcaagttgttatgctttagaagactgactttaacctatttaagctatgaactcagaaaagcatctcaaccaatatgtttgttgccattagcatcatttaccgagctgtgtacctttaatttctgccattctataatccttccaaggagtgtttttatcagttagttagggatagctggtttaatgctgattcccatgcaaagttagcccggttgtatgctttttataatatgcaagtacttctggtgttaataaggttaaaaaatagaagaaacctaaattatacaatctacagttatcagttctattgagctcactggaatcttctcctactttatagacttccttctttttcatttttttcctaattgcttagacttgttgtatatgactttttgttctttttcttattctacaatctggatatttatttagggctttcatgacaccttgtagtctgggttttcttcccaattctctacctattcattcttcttcatcttgactttacatatggaattcattagggctctcatctaggtttccttataactctcagttgttttgtttatgcttaaatgagaacatagaggccataactcagaaactgtctattcttcacctataaattgtccctgccacaaagcagattcactgtgcattggtaccacttcggctcactgcatcttgggctgcagtttctactacttaagattgagtccagtgatttagaacatacacacaaaaagttgcatgaagcaggcttattgcttatagataggcatcaagtgacacagaagcccggcgttcaggaggagccagcctcccaagactcagaccgtttgcccagggtgttgaagactcatttgcacatgccctatttgtaccacagctgagggacccttgaaagaagcctgccccgtgttttataacccaggcatcccatgatacactgggctaaagcacttaaggaaatgttctaagaggcacagtaagagagtctgagacttatctcaggatgttgcattcccagctcattctacagctattcttgagatgcacaagttatagaggaggaaaacctgggttgctccaaggccacttggagagttgtcctgcatttcctctagcattttccttttttttctcctattacaataaagaaagtacatgtcattctaagaaaggccattttctctgcttaagttaatgataccattccatttttatcttttggaggactttagattatcctccctcttttgatttagcagtctttccctttcttctgcattagtcatcctagattacatgtattacagtcttccaattaaaaacatcaatgaccatcctcagatattcttctgggtatattactttgctcatttccttgctccctctcctaattaaacatctctttttatcacactgtctccacatcctcagcctccgtcattattcatctctctactgtccagttttcaccattatcacttcattcagtctgctcttgtcaacatcatgagtgacatttatgttaccagtccaatatatttctctgtcctcaccttaaaccacttcatagcagtattaatgatggtgggtcactttctctttctatcttccttttttcgtgttattctactctcctggttgccttctgtctcattgattgctctgtttcaggtttttgtttttttttttatcttattcttaggtggatcatcttattctgttccacctaagtcctaacttttatctatttctcttctttatcttctcttctctaggtgattggaatcatttccatggattttaaacaaatattttctgtggacacctaggtatcttcaattcagaacttggacttcagcctcatacttccatcagatgcttgttatcaccacttccatgttccacagacatctcataattaacatatttaaaatggaaccctcattttttttccttgcataaaccttttactacattattttcttactgcttagaaacccaggatattttctgatttatctctcttagctcaacaactttatctcttcatataaaccttagcatgaactattaattgtatcttcaaaatatctcttcatttattgcacttcttttgtatcttctatcacccctttatccagctcacaattatctgttctctgcattccaaaacaactctgcaactggtctcctatttccattattttactgtctccctttattttactaaagaccacaacattatattcatacaatttaaatccaattaaaatgttaatgcttaaaactcttaaatttttattgcattcagaataattctaaccactcatggtagcctacaaaatcacaccttatcagacatgaacctcagttctattcttttcccttgacaatcccatagccttaggtattctggtctttcgtcattttattaaatatgccatgtatttttattttatgttgtggactttttgtatgtgtttctccactcttttggaatcctcttaactgagttcttagcatggttggctcctgtttttataagtactcccaaacacaggaactagcattaccattttttcagtcctgcagttcagaaatctggggcttacgtttgaaaccctcttctcttacatttcccagaacaaataaagcactgaatactttagatttttgcattctatttcttcactatattattttctctttctacttctactatctagtaacccttttcttcaatgaccaaaatctattttacttccagcaatatggtgaaaagactatcgactcttaatttaaagccagactttattgtttataacaaatgcattgcagaatgtaaacagagaatgtaatcacaagccaggggctgggagcacttcatattagtttcttaacatgtcagaaccacattctttcatttttataagagagtaaccagagagccactttaagaatttttagtggttagcagaggagtagaggagagtgcccttgatacacaggtagtggtgaacatgtatctttacccccagcaggagagaaaagataaacattagagacataagctagcaagcttcaaaaaggatatttgaaaggggttttgtaatgggatatcagtttttgtacaagggaatttatttgtacaagaggttacggagcttttctcggagaataaaacaagcctgtctattacttgaaattttaacttttagaatagcttacgtgcacttatgctgattattgaggggttgactgcagcatcagcgtccacttcagtcctttctccaaccattccattatctaccatgcgatcagagtgatcttttcaaatcagataaccaccaccacttaccttaggataaaaagccaaaattcttatcagggcttgtaaccctgtgcttgaagtcttacctcactcaattctcctctttaatttctgatctctaaccatgctaatcttttagttactgcaactcaacaagatctttttagttctttaatttcaattcaagagacattctgctctttctgcttggaatgctcttttcttacctcttctcctaattaactcctgttcatcattcaaatcttaattcaaatgctgatcctgcatgaatatttattcagtattaggtcaagtcccctgatgactgttagcaatctctgtacttcttatcactcagcatagtactgtgggaaatatctgcattgttctttattgaatccttagtctcaggacattatccagaatgtcttacgaagagatcaataattatttgtaaaatgaattgagataataataaaagagaaaaataagagaaaaaatgtatctatttttgagaaggagaacatttttaatgaagatgtggccctggaatacagatgtttctctcatttttttcctatttcttcccaaatttaattaatttctggttaaccctgatttctcagatcataaaaatcatggggaaatcaactactttggcaataacccatcatgttttcaggatttgtaagccataacaacagtaaattctttggtgagctatactctcagtaagtaaatgaagaataattcaaatattattgggaaaatgatgccacattcatctgaatataataaatgtgaaattcattttactatgttcttagaactttgtaatactaatttataatagcagtttcatcctttagatatttcattttatctacggatctaattcttcctgtgaaattactgagctatttctctattcttagaagagaaaataactctttgtgataaaaatcattactatgtataattagacttccgtttacaagtcaaactgaaccaacgaacttacaatcatagaatgtgactagtcacagggaatggttggggcattagctcagtacctgtccaaagtgagctcattattatgattattagtatcaccattatcaatcagcttccacataaagtgtacctaaatgctagatctatatgatagcttccaaaatgacactgatttttaataatccaaatctttaaagagatcactttccattttagaaaaatgagatttttttttttttggaaaagatagaaaaacctctaagcattttaaccaagggttttagaacactttatttttatgaatatatcaaagcaaattccttctttattttgaaagtgactggaaacaatttcacggtcttactaagggctagtttaagtgagtctcaatttttcttctgttttgtttgctcttacaactttcctcacacacacacacacacaaagggagatataaaaaaatctagatataacagatgcaacttacaattttttggtaagaaatcataaagttttagaaaaaatcatttaggagtgtcaataaaaacgatatttaagaaaacagtaggaaaagtgatatattaaaagacttttaaacacctttcacaagaaattgaacagatgtgcaaatacacattatacgttatctatttgctcattttatcctgtccttaaacataaactttgaagataaaagaaagaagtgtggctcagggtcactcatgtaatctgtttttaggcagaaacaggtgtgttgaaaggtttttaggtaaaacaaccaccacttagacttcaataaagtagtatttattattttcctataattgcaaatttaccaaatgtaactcactattttttctttaatattttcaaagatatttttgagtaattattatattttcacaatcaattcagtagacatttttgaaaaacttatctgaacctagttttctcatctgtgaaatggaaacaatatatactctctcagtttgttgtgtcaaatgagaaaccatatatgatatactaaccactggttctggctaaatgcatacctcctcatcttttcagtaaagacatgactgttggccaggcacggtggctcacgcctgtcataccagcattttgggaggctgaggcgggcgaatcacttgatgtcaggagttcaagaccagccggaccaacatggcaataccccatctctgctaaaaatactaaaattagccgggagtggtggtgcatgctggtagtcccagtcccagctactcgggaggctgaggcaggagaatggcttgaatggcgctgggagattgcagtgagccaagatcatgccactgcactccagccttggcaacagagtaagactccatcccaaaaaaaaaaaaaaaaaaaaaaaagtaactgttattctcagtactttgggccagcacagtactgatactctcctaaaatctaactcaaagagaaaaatcacaaagcattggaattggagcagaaagtaatgtattcttgtttgacatctttccacattcagtctgtgtactgttagctgaaagctagttgacacaaaatgctgtcttaactttagtgttgtttctaatttagttctaggtcataaaatttgtaggaaagtctaattccaaaactttatcaacagctttgttacgctcaggtattatgatcagatatcttatgtgtgctctatgacctcaagcaaagattaaataaatctgtacattacagtgaagacccacatcaaccaatgcaacatacatttatttttcgcagcactcttttaggtgctttgaaacatgtaacccatgtttaagtgcagaggatagctggcaaggcaaaatataactatatgatgtgttaataagaatacagaggaatagttaaagtgatgcataataaagtacggaaatatgttgtttgatttcaaaggaaggggatagtacatatgctgaaatggcctgggaaagcttaatgataaggaaggtcttgagatgggtaagagagatttgtaaggaagagaaaggagggaaatttattccaaaagaagaaaaagtatgacaaaagcacaaaggaataaatgagatgaatggcagaaaatagatcagttaatcagtgaggctagagaagcacgtttatggaacactagtgaaaaatatgatgaaaaggtagaatgtgaccaataacagaaggatccattttctatcaagactttcttattagatttgatatgttcataccagcaatgtcatctctgaatataaaagatatctgtacttacgcaacataattatatgttatcactgggaaattctaggaagtaattatcagtccctttattaatattactatagaattaacttattcagttatagggtacactacgtttatagtttacttccttcctcccccagcctccagctttgtaatttaaatgaaactaaattccatcataattcactcactaacacataggactgccaacctctgaatggctttagatttgcgtgaacctgtatttgtcaatgcttgctccaggattctattggcatatgtcgaaataattgatttttatgacaacctgcttcctgcttactgttttttaccatagggagggaaaaaatagaattatcccttgatttagctgtcagtcaaatgacaactcaagcatgctataaaattaaagaaagccccacattctaccaggaactgatgattttagtgatactgctctctttgtagaagaaataaagtattttcatatcttatgatgaatatcactataatacattaaaatatagaattgcatccagcaaaatatcctgaagtggacaaaatatgcccctccaaaatatgccatttttgcacaataatttttttgagcagaaagcaattagctcactgactttcacctttctaaaagcaagacataaatttcaatttgtaaagacgtctccctttagtgtacttgtaagaaaactactccatagacaactcttaatagctgatgacttatctgcataagaaactttattaaacaatcctgatttagaatacatttcttcccccactttcccgtaacttacctcctgcaccgagcagccctaaacttcttttctttggctagtctaagatatacaccccaaatcctaattgcctctttgcatcacatttctttgtgaatttccatgtgtatgtacataattaattgttatttttcttgttaacttgtctgtgatcagtttaatttgtagggtcccagacactgaacctaggatggaagagaaaaagtgtttctgctttcctatggcttaggcaaccatgaatggacaggcagggcatcccacttgctccagaggctgcagctcaattgagatctgacaaagctgatgtgaaaactttactgaaccagatcctggaattttgcctacaaaaatacaaatacagaactctgttttttcttttccaaattcagatttgcacgagaataaaattataagaattagttctttggaatgtgattctggtgaattttctcctgagtatcattggttattgaccctttcactcccagggagagccattgctttcctgtgtgtctcattttgtgtcttgagcgcttggattcactttcttcctggtggcagggtccacattgttgggcttgctgtacaggcagtcagtcatcagattgtatgccctgagaatttgtagatggtcagatagagatgcaggttgcactgtcttgctactgatgttctaccaaccctctcagagggtttgtctaaatttttatttcttttggctattgctgggaggaactccatatcataaggacttcatttttgcactctctttgtggatacctcttacgttcttggctatctacattattaaatatgttttttccctctcttattaatcttttatttatttaaaagtggtgggttcccatggccttgggcatctctgcctctgtggcttcacagggtatagcctcatcctagctgctttccccggctggtgttgagtgtctgcagcttttccaggtgcagggacaagctgtcggggaatctaccattctgggatctggaggaaggtggccctcttctcacagctccactaggtggtgccccagcagggatcctgtgtgtgtgctctgaccccatatttcccttctttactgacctatgagagtttctccatgaaggccccgccactgcagcaaacttctgcctggacatctgggtgtttccatatgtcctgtgaaatctagggggaggttcccaaacctcaattcttgacttttgtgcacctccagctcaataatacatggaaaatgccaaggactggggctaccaccctctgaggcaatagcctgagctgttccatggccccttttagccatggctgaaggggctgggatgaggagcaccaagttactaggctgcacacagctcaggggtcctatgcccagccgaagaaatcactttttcctcccaggcctctgggcctgtgataggagagtcggctgtgaagacccctgacatgccctggagacattttccccattgcctttgagtttaacatttggctcctcgttacttattcagagttctgcagctggcttgaatttcttctcagaaaaagagatttgccttttcaatcatatcaggctgcacattttccaaactcttatgctctgtttcccattttaaaactgaatgctttaacaatattcaagttacctcttgaatgctttgctgcttagaaacttcttctgccagatacactaaatcatctccctcaagttcaacagttcacaaatctctagggtaggggcaaaatgccactagtctctttgctaaaacataagaagagtcacctttgctccagttcccaacaagttcctcatctttatctgagaccacctcagcctggattttatatcattattgacattttactcaaagccattaacaagtctctagggagttccaaaccttcccacactttcctgtattcttctgagacctccaaactgttccagtctctgtctgttacagagtcccaaagtcacttacacatttttgtgtatcgttttagcagcacttcactcctggtaccaatttaccgtattagtccattttcttgccgctgataaagacatacccaagactgggaaatttagaagagaaagagatttattggatttacagttccacgtgcctggggaggcctcacaattatggcagaaggtaaaaggcatgtctcacagggcagtagacaggagaacagagcttgtgcagagaacatccccttttttaaaccatcagatcttgtgagattattaactaccccgagaacagaacagcatgggaaaacctgccaccatggttcaattatctcccattgggtccctcccacaacatgttgaaattaaaattgggatttgggtggggacacagccaaaccacatcattggggatggaactttttattgtgagtatgtctgcacaagttacctgtgtagattttcttgtctgtgtggctgtgggaatgtcttagtcaaacacccctatgcaagtttacttatctatgactatagtttgattttttaggctgttcttttgtttgaatgaattcaactgagtacccaccctaactgcctgcctgactggtttgtttatttctcctctctcatttttacccacgggagtggagagcctaactgctgttagcgaggtggggtgatgctcgctacttcctgctggaaaggggcattgtatggggaacagcagctagggttccttctgtgagctttctaagggtccttggaagaaatttgtgtccatgcatggtttcatttgcatcaacatttgtagtttgatagactttaggcaagaaaaaaaaatggattattagaggacatgtataaaaatgaaacaaggggataggtaatgaaagctcaaaaatctcaaggcttcagccatgcccagataaatagtggctatagttatgcctactaagatttgggtgcatggggctttgctttggtgaacttccttggttttattttcccaaacaaagaaacctctgggttatgggtaccctgtatactcccataacctggtaggatttgcaggataatagcccaaaactagaatattgattcagatttttacactacttattccttttttattttgagttgcagccagagattgctggtttgtttacaggaataagcagagttattctaaaatgtacgtgatatggtttggctttgtccccacccaagtctcttctcgaattgtagctcccataattcccatgtgttgtgggagggatctgtgcgagataattgaatcatgatgggtgtttttccccatactgttctcatggtagtgaataagtctcaggagatctgatggtattataggaggaaatccctttcatttggttttcatcctctttcttgtctacttccaagtttttgccttccatcatgattgtgaggcctccctaaccatgtgaaattgtgagtccattaaacatcctttttaaaataaattacccagtgtcagatgtgtctttgctagaagcatgagaacagactaatagagtaggcaaaacttaaaaacaactaatgagattagaatttaatgacaagtgtatgataagttttgaatcaaattttgctctctccagtcctcatttttgttcaaaacaaatcatgatagtcattttgttaaaaacaaattacgactgagttgtttgcaatgtaaacttaggctcatacttggcttgattatttgcataatgtgcagcaaaaataattatttttgcagtcttttaaaataagctttgatggaactctgttccacaagagatctcagataggacttttttaaagccaagcccggccatgagtttgtaccctcaaatacctatgagttgagtgaattcctctcttcttaatgtcacaagaatatgtggttcctgggactgttatatagtgacattctttactcatcacagattagaaaccccgtacacagattatgtagacaaggtaggaggccacatttcccaatgggcttttattggctctgtaagtgaagcttgattcctcaaagagaagcatatccatccaatcaaagccttggtaaaacaaccagtttctccaattgtgtcatgttgcaaaagaaaatgaattcttactgcactggtgcaaacaacgatattgccataagtttagaatattcccaaatagtttccaaattctggagtaacttggcagagagaaacaaatacgctccaaattttgttcactggtgtataccttacttaattcttaaaagctgtagatagcttaaaagaaaggtttccttaactctgaagaacaaaacaaagaacagcaatgttttaagcaaaaagtaaaaaaagattatttcagacttctattagtttagttcatgcagttaactcctgtctgatattcataaacagttaagatcttcatgactcttgtatgatttcttttattctcatgtcatgatttccaaagttatcagaaacctgcatttgagagcacattgtaaagtcctacagctgattgtaaaacatcttttgaagaggattaaaacaagacaacatttatctgtagatgacatagtgttcaggttagttacagtgaaaaacatgactggcaaagatatttggttatttctgtggtttgcaataacttaatacaataatcctaattatgatccatagcatattctcaagcattagaatttttaaaatcccatacaattttggaacatatattaatattatcactaaaatataacctgaataaggttaaacataattttgtcaatcccacttacatgaacctgtcaaaaaattctgtttacttctcttctggatgcttcagggccctctgtagcatacaaaaggtagggttcaggagagacaattttgaatgtgaagtttgattttgggaagcctgtcaaatgttacaggtttaaaacacttgatagtgtgaaatacaattccaggtaacacataagttatttattttggcaaaaggatgactcagaaattttaaaactaggcaacatcctttactccttaagagggaggacttcgctttccaaacagtttgtctcctgtctactcttttctctctttggcagtctcccaacaaggcaaacaaaatatttcattattcttctctattacatgaaaaatctgtacaagggaaagaaagccaaattttacccttacattggtttcaaaataatcctttttcattggcaaggtttatattttatgcctttttataatcttttatgacaaacacattttactgttcttacacaccttgcaggtaaatttatttttagttgtcttatttacatgttttaatggtaaatcttaccaattttaacgttaatataaaacctggtaagttgttttaattatgtactagatgcagataaagtctgatttttccatcatatttaggggcatggttaatttcatatgtccccaggccttaccaagttgtaaggtaggtagcatacaaccttgaaacatttagcaaacctggtatctaacttacatgatttaaactttctatttacattttgatgacatttgcattgtaccaatttcatctttaaaacaattactatttcttagaggttaaagtcccataaactaaaaggcattagagttttaactttcctctaaaatatttgatttaagtgcttatttttatttaaggcaatcaattagagctcattagagacatcacacacaacacatatatcactacacaggcaaacagaagaagatccagtagttctaagatttttttcttgtcccatttcctaattgaattattagctttccagtggagccctttaagagcaaggatagaaaaccatgaagtttctagggcctaatcaacttgtatagctgtaagacaaaagcagattttgagtggaatctatctatgagcctctaaattctggtattccatgaggaaaacagaggtttctcccaaaatggaacccatcatgccttttctgtttttcccaagaagtatcaggccagcaaaagttatcttgggttcattaagagtggaaagacagagtggagaaaacttattcagtcaaaacaaaagttatcttgggttcattaagagtggaaagacagagtggagaaaacttattcagtcaacacaaaagttcttttcaagaaaaacacaatccaagaagagaaaaacataaaggccttttaaatatacctataacatgaatatccacttttaatcaagctgagcattctttaagaaaatcatttgaaatatgctgttacctgactttagctaaatcaagcaggtaatatttctggcttttgactttaccaaaagtaatatcaaaggtgaaacaacaactctcaattaggttataagttaaccacgagtatacaagatatcttataagtggtggtaagcagcttttaccagatctagaacctttaaagtcaattcagagaaaagaagatttcagaaaggaagttagagttgttcatggaggaggaagagaagattaaaagtcacacagctattaacttgtaagtattcattacccaaaccaggagcgaacccgggccaccattataaaaaggcaatggctaaaaagaagtactgccacattgttacaggttatggtcaaggacataaaacaagatggagacttgcagcaaagtttgttactaaccagtttacaggggtgacttgaacagtgagcttacggagtcccaggcctggattccgttccaaggtaccctctctctgattgtttcttgtattttctctcctttttctgagactcctcctagtacctgttatgaaagactggggtggctactcttagaaggttttttaaggtgccatctggttctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagggttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatttcttccaggcagaagctagaaagagaggtttgaggtttaacagactgtcactatatatgcctcccagctgtagaaaattaacttgtctcattaataaactgttcaaattcatttagcagtggtgagcttttacatgaaggaaaagcaactaaaatggagagggatgagggtattcactcgggatgaaatatcttttcatagagtaccatgaatgactgttattgtgggacaaaaagcacttactgggtgaaggtttagactgaaatcttgaaatcccctggtattttgagtttctgcttagcctttccaaaggaataaaatcagatatgtatctatctcagtgagcagaggagtgactttgagtagaatgggaggaaggtttgtcctaggcagtttcccgcttgaattttccctagtgatttcaggggcccagtatattgtcctttcacacatctgacaagtaattgataaccagaatatctaagcagctcaaacaattctagaggaaacatatctaatagttggatcaaaaagtgggcaaaagatttaaatagacatttctcaaaagcagacagacatatggcaaacaagcaaatgaaaatgtgctcaacatcatcgatcagagaaatacaaataataactacaatgagatattatctcaccccagttaaaatggcttttatataaagacaggcaataaggattgctggtgaggatgtggagtaaagtgaaccatcatacactttttatggttatgtaaattagtacagctgctatggaaaacagtttggaggttcatcaaaaaactaaaaatagagctatgatgtgatccagcaatctcacagctaggtatatacccaaaagtaagaaaatcagtatattgaaatgatatctgcactcccatgtttattccagccctgttcacaatagctaagacttggaaacaacctaaatatccatcaacagatgaatggataaagaaaatgtggtacatacatacaatggagtactattcagctataaaaaaaaatgagatcctgtcatttgcaacaacatagatggaactgtacattattatgtgaagtaaaataagccaggcccagaaagacaaacatcacatgttctcatttatttgtgggagctagaaatacaaacagtggaactcatggtcataaagagtagaaagatggttactagaggctgagaagggtggatgggaagcaagtgggaatgttcaatgggtatagaaaacagaagaatgaaaaagacctagtatttgacagcacaacagggtgactatagtcaataacaacttaattgtgcattttaaaataaataaaagaatataattggattgtaacataaaggataaatgcttgtggtgatggataacccatttaccctaatgttattattacacattgtctgcctgtatcaaaatatgacacatgccctgtaagtttatacacctgcaatgtaccaacaacaattaaaaatttaaaaaggtgtatccttcccagtgaaccaaaatattttacattgataacttttaagttatcatagtgtgttggaataatcacagctttggaaagaaaaaaattatagatataaactttcaaagatggcaggagatatagatctctctttagtggattaaaatatgccatttgttattaacatcacactgagattttttaacacaggacatcttctggaaatgatatgattataggagttataggaaaaagcgttttttcatactgtgattacctatgctatgaagaaaggagatatttcctctatgatgtctaatttagcataattattgtttttaaactatatttagatttaattaagagatacacaaacaaattacttttagtagtaagaagatttttaaaaattttttgtgtaagatgactatgtagtaaagaaggttacaaacttactttttaacgtagaaaaataatctcaccttcttgccccatggaaaattgaaatgttatgtggaacccagtgtagaaaaactctcagtgaggttttctgtcttaagtttcagtggattgaggtgagatcaacgcctgttccacctttttcctccctgtcctagcaggcttgaaaacatttatacagccataaaatgttgcctttaaattcaagtatagaaaataaaatttaaaatgtgatatttttatatattttattttaatatcttacatgggaaatgtttttgaaatgttaaaaaattaaaatttttaaaagagtactgtgaaataatctaatcacatgtggaaattttgttactatttccccaagcatttttggtacatttaatgagttgaatgtaactcataagtagataaaaatgtttaatatttaattttctgctgcaataatgttacaaaacaaccttaaattctcagtaacgttaaacaacatatttttttctcccaaatttccaggttatttaagggcagttctgcttcatattgcagtttgcctgggctttactccaggctgtgtgttggagttaggtctaatatattgtatccctacgtatcccagttagaaagcctaacagatttctttgtacttcagtcagctcgattgtatttgtcattcaaaagccaaagcatttatcctaacaccaattgcttcttttttttttttagatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtaagccactgcacccagcctaactgactgcttcttttgttctgtagtctttctccaaaactgtttttctctgtactcactttcaccttctctcacacatatatgtccctcatgtccctttatgtctccagggtcttctatttccacgtaatcttaattgttcatcatatcctggactcatgagtaattaatctgttattctccctgaaagtgcagccttgttgaatagaatgtgttctttaaagagcagctttgtttctcgagtgaggtattaacttccagatttaagtgaaaatgagttccaagttttatgtttcattgtgtgtctaagactgacaccgtttattactgtggcacttacagcttgctttcaatgcctccaaattctctatctgaagggctgggtaccatatctcatgtctgaacatattcctcagaatcatgcagtaccagctatgttccttctttatattatggctcctgaggtgcctgttaagcagccaggtgaaattgccttttaatcagtataggaacagtctctttcctgctgatgctaatgctttttgtaaaaaggtcatgctgtattgaagttcttctttcacggcaaaaccactaatggaactcatctacttactgatgggtggaagctctttgtatgccaaagtcttgttttgtttgtgaagaatctctttccctcaacagtgatgtgctacgttaggtctcaaatcattgttgctttttaatccaaatttatgacaaagattttcagtttgtatgcataatttccttctctggccttaaccatcagtctgtggacttgccaagcaacaaccacaagaacaacaagtctgaggtcaagagacactatttagatctcagaatcatttgttgtcctttatcctttgacaaagttttgcctttctttctttatgagattttttccctaatggtttctcaatctcttgagaagaagaaagttcttgactcttgcagtctttctcattagttgaattataccatcagtacagcttctgatcatgtcgagaaatccaccatgaagaaataaaacatttccgattacatggattacgtttcttggattcttataggcattaaacttcattctaggatacaacctcatgatcttgtcttattctcagaacaagaaatatattactatatacattacaatatatatatattgcagtttccttgctatatatatatatatatgtatgtattatagtaaaccctgtaggcaagcaggaacacttcagaagtctcaatgaatccatcattagctgttagtaatgacaacactgttagaattatttcaataatcacacattgttatggtctgaatgtgcacccccaaatgtaatatgttgaaattttaacacctgagggcatagtattaggaacttgggagtggaactctttttagtgctattatgaataagatgcttgccttttccagcaaatgaggacacagccacaagctgccctctaggaactatgaagttagtcttcaccagacacaaaatctgcttgattttgaatttagcctcccgaactgtggaaaataaatttctgcttttataagccactcaatttatggtatttggttattgtatcccaaacagactaaaacacacattatttacctcctttttggactgtctggggttgttgctttaaacttgcttcagtgcctagaactgctccaagctccctgtcctctggcacacacgtataaataattctgctggaaaccgacatgtttcactcagtcatccaaatgtatttataatgttgtccaaatatatagcacttgttacaatgtttacattttagacatattttgagatatgtgccttaacagagtgctgtgattattattaatatttagtaacttatcttaccagacctaaactcaaagtttttcacaatggcaatgccttatttgggacttatttgggactgaatgtatgaagatcttacattgagtccaaattgatttctctgttagtctcgcaataacattaaagccacagaattatctgctgtatatttcttgtcttgttgtagctgatattctacatattaggacaattaggacattagtaatatctattaaccttagaataaaatgtcatattgaaattgaagaggaatattggaactttgctaagaaagaatgcttttcacacacaatgatatctaaaatggagcctctgttcctggaggtatattttacaaaaattcagtgttactataggaattctgtacacttctttcttagacatttgtattccatcagtgtcagtcctctctgtattttaaactaaataggatttctttttccatctttctgtttgacaagtattgttttgctgaaaatttgctattcatgttcttttaactcattagaaagaatatttagggtctttagtgacaaatgacatggtataaatgaaaagaaaacactgacattgtaattgagaaatactaattaattaggagaatattatttaaaaacattgtttaaatatttctttgttttattattattatactttaagttttaggttacatgtgcacaatgtgcaggttagtacatatgtatacatgtgccatgctggtgtgctgcacccattaactcatcatttagcattaggtatatctcctaatgctaaaccctcccccctcccccaaccccacaacagtccccagagtgtgatgttccccttcctgtgtccatgtgttctcattgttcaattcccatctatgagtgagaatatgtggtgtttggttttttgtccttgtgatagtttactgagaatgatgatttccagtttcatccatgtccctacaaaggacatgaactcatccttttatatggctgcatagtattccatggtgtatatgtgccacattttcttaatccagtctaccattgatggacatttgggttggttccaagtctttgctattgtgaatagtgccgcaataaacatacgtgtgcatgtgtctttatagcagcatgatttatagtcctttgagtacatagccagtaatgggatggctgggtcaaatggtatttctagttctagatccctgatgaattgccacactgacttccacaatggttgaactagtttacagtcccaccaacagtgtaaaagtgttcctatttctccacatcctctccagcctacaatgaactcaaacaaatttacaagaaataaacaaacaaccccatcaaaaagtgggcaaaggatatgaacagacacttctcaaaagaagacatttatgcagccaaaagacacatgaaaaaatgctcatcatcactggccatcagagaaatgcaaaacattgtttaaatatttctatcacaaattgacagcagtacaatgcacaccaccagcaatgtataattctagatatgagaggtaaaaagataaaacaggtattgcattttctccagaaaacttatcatttagtggaaactggccaataatttcttaggccttaggataattttacctttgattctctagttaatccaaaatatataaaaatattaaccaaaagtatatatttttaaaatgcctacataatctaatgcagtattttttgctctcttcttgaagtgaattaaattccttatcactgaccataaaattgaactccattgatgattcttatttaaaatagttaaaagtgaatgtaaagatcagttgtggttttccttttcttacccttgtttttacacttatatttgcctgtgtcattcacacacttttagaattcaaaacaataactagaaatgtaatcatttgcttttcaaaagcttttcgcatctttccaaagttaatataaagtcttacaaaacttttagctaattcacaaaaaaatcaaacatatatagttgaagcaattttttttttttggtagatttcttcaaaccacagaaatttcagttatggcatggtaggtcttttgaaatgtttcattttttgtatttgaagatgcagagcaaaagtatttccactccaactcccctttaataaaaattgaatgtaacaaaaaaatcaaaatctataggaaaataaccccttcatctatgttaaaactatgagatttccagcccaaataagttataagaaccagtatagagtccaggctcggtggctcacgtctgtaatcccggcactttcggaggctgaggccggaggatcatgagttcaggagatccagaccatcctggctaacatggtgaaaccctgtctctactaaaaatacaaaacaaattagccaggcatggtggtgggtgcctgtagtcccagctactcaggaggctgaggcaggagaatggcccatacctgggaggcggagtttgcagtgagtggagattgcaccactgcactccagcctgggagatagagtgacactccatctcacaaaaaaaaaaaaaaaaaaaaaaaaaaaaaaggaccagtatagaaatactaatacagtaaaaggtggacttatatataaagaaaataaccaacagattttgtctatggcacaaacttcttagaaattttgaggtctttagccttaaagacctaatcaaatatttattactttgaacagtgagctactgggatatgctgggctttgagcctatgtacaaatctaattttagaagtcaggacgtgttgtaagcaatagcaaagaatatgctagatgatcagcttggcaattgttgaacaaacttcattcagcagtgtgaggacgtaattaaagcagttgaccttcaatctattcactctctttattggcaaatggccgaggaataagactagaaggaagatgaactggtttagtctctttgtcagctgaacttgtggtgaaagagactactgatattttctaggatgaagagatcttatctctgaaataccctttgcaggttgctcctgactgaaacaaattcacagattctttcttctcgctcaattttgctgttgattcttcattttacattctttatttcatttattttatgctttagctctagaattttagtttgggttctattttttcaatctgtctgtggaacttctcaattggtttgtgttttgttttttttcaagttttggttgaattgcctatttattctcttgtaactaattactctcctttaaaacaattatttgacatgaaaaaccttgcaaaaatacaaaaatctataaacttcttgacaaagaattcaaaataattattttaaagaatttctgaatttgcagcaaaagtttgctatagagcaacatgaaagcacagaaaagtatgaaactcattgattaaggtaaatatataaaaaatacagaacactctaatagtgtagtagtggtgtgtaaatcagttttattgctagtatgaagcttaaaatccaaaataataataattatagctacaataatttgttaatagatatagaatattaaaaatatataatgtgacaccaaatatataaaatatagtgggctgagtaaaagtatagagttttgaatatgatcaaacctcagtttaaaatagtttgctccaactacaagatagtatgtataagcttcatgctattcggaaagcaaaaacctatagtagatacccaaaagacaaagagaaatcaaagcatgtcactacagaaaatcataaaatctcaaagaacgacagcaagggagaaataaaggaacaaaaatatgttaaaaggctgaaaagcaatgaacaaaatgtcaattgtatgttcttatctatcaataattaccttgaagataaattcattctattctacattcaaaagccagagtggctgaatggattacaaaaggagacccaacaatatactgcctacaagagactcacttcagcttcaaggacacatatggtgtgaatttaggggatgagaaaatttgatattccatgcaaattaaaacaaaaaaacaacatggataactatccttatatcaggcaaaatataccttaagataaaactctaacaggtgataaagatggtcactatataatgataaagggatgagttgattaaagggatgaaacaattataaataaatatgcacttaacattagagcacttgaaaatgtaaagcaaacattaatatctggagggagagatacagagcaatcaataatactacagatataggtaaccttattgacactgttgaaattatcaatactccaattacaacaatggatagatcatttagacagacaatctgtaaggaaaaaaaaattagacttgatctgcactttagaccaaacggacctaacagatgtatgttcacatttcatccacagccggagaacaggtgttcttttcaagctaacaagaaacatcctctaaaatagagcatacttgaagtcacaaaatgtcttaatacatttaagaagattgaaattttatcaagtatctcttttgaccacaatggtatacaactagaaatcaattaacaggaggaaaactggaaaattcaaaaagaagtgaacataacacaattcttaaaaactggtggtttaaaaaggaaataaaaaggaaaataaagaaatcttgatacaaaaatgaaaacacaatacaccaaagcttgtgggatgcagtaagacagtgctaagatgaaaatttgaaatgacaaacacctacattaaaaaaaacacaaatatttcaaataaacaatctatcattaaacctcaaggaactagaaaaaaagaagagcaaactaagcccaaagttaatagaagaaagaaaataagaaagatcaaagcaaaatagagaaatagagagtagaaaagtaatagaaattgaaagacattctgtgttcatcaatgtgagaaattaatattgtcaaaatgctattacacaaagcaatctacagattcaatgtaatccctatcaaaagtccaatggcatttttccagaaacagaaataaatcctaaaatttgtatgaaattacaaaagactataattacccaaactgatcttgagcaagacgaacaaagtaggaggtaccacacttctcactttcaagttatattactaaactacagtaatatatatatatatatatgatactggtatgaaaacagtcacatagaagaatggagcagaatagaaagcctacaccaatatcgtcaaagaatcttcaataacatgcccaaaacacctaatggagacaggatagtctcttcaataaatagcgttggaattattggaggcccacatgcaaaagaatgaaattggagtgttatgctatgcacaggaataaattgaaaattgaaaaggaatttaaacataacatctgaaaccaaagaatccctagaagaaaacaggggaaatcctccataacattgaccttggcatgatattttggctatgaatcccaatgtatagacaagataaacaaaaataaacacatacaactacatcaaactaaaagattgtggcacagtaaataaataaataaataaataaataaataaaaagtcacccatggaatggtagaatgtacttgaaaacaatatatctgataatgcattaatatctaaaacatataagaaactcataatcagaaaaaaagtaacctgattaaaacatgagcaagagacctgaatagacattttttcaaaggaagatttacacacggccaacacatgaatgaagaggtgcacaaaatcactaaacatgagggaaatataaactggaatcaaaatgagatgtcacattacatctttcaaaatagctaatatcaaaaaggcaaaagataaatagtgttgacaagaatgtgtcgaaaagagaacccttatagagttttggtgggaatgtaaattggtacaaccattatggaatacagcatggacactcctcaaataattaaagatgtaccgtatgttacagaaattatacttttaggcataaaagtatatacctgtgggtgtgttggctcacacctgtaatcccagcactttgagaggtgagggaggcagattacctgaggtcaggagttcacgaccagagtcgccaacatggcaaaaccgcatctctactaaaaaacacagaaattagcccagcgtggtggttggcacctgtaatcccagctacttgggaggctgtggcagggagaattgcttgaacttgggagacagaggttgccatgagtcaagattgcatcactgcactccagcatgggcatcagagtgagactccatctcaaaaaaagggtatataccttttatatacttttccttttatatacgatagaaataaaatcactatcttgaagagatatctgcattcctgtgttcattgcagctttattcacaaaaaccaaaatatggaaacaatctaagtgttgacagatgagtaggtatgtaaattatgatatctatcatctatctgtctatttatctatctatctatctacaacggaatattattccgtatttaaaagaatgaaattctgccatttccaacaaaatgaacgagcctagaggatattatgccaagtgaaataagccaggcagagaatgaaaaatactacaggtacaacaatgaaaacttgccattataagatgaataagttatggaggtctaatgcacaacagggtaaaaatagttagtaataatgtatgctttaagttcactgagtgtagatcttaactattaccctttcccaacacatgataactatgtgaagacatgaatatgttaattagcttgattgtgaaagtccttttaaaatatacttgatgggcgcagggtgagaggagagtgagggtcaaaacactacctgctggggactatgctcactagctgggtgatgaaatcatttgtacaccaaaccccagcaacatgcaattacccacgtaacaaacctgcccatgtacctcctgaacctaaaatagaagttgagaaaagaaaaaaaaagatatcaatttcctataaggagctccaggtttgttccaaacagtagcgagacaaacagatcaaggatgaaatatataaaatagtaggcaaaacgtaaacaacatgtgtaaggcaatcgattctatataactcagcaactcctagggttcttatcaaataaaatcactgatgtgtcataacttctaaactaaaaacaacacaaatgcccattcacagtagaatgaataaataaattacttttgcttcccgcgatgaataccacacagcaattaaacaatgaactgctgctacacaaaacatagatgattctcacaaatttcaactgagtgaaacaagtcagactcaaaagattacatacagcaagtttccatttatatgaaattgaggagtagggaaatccatcgtgatagatttcatgataatgatgaccattggtgagtaactggttgagaaagtgcgagagccaggggtgtgggagctggaaatcgtccatatcttgcttgatttgggtggtggtgatagggatatatacacttataaaaattataatgctatatgcttaagatttatgtattttactatttgtaagatatatattagttgaaaaaatgcttcagtgtaaaggaaaccagtaaaaatacgctacctacaattgtagcttttgtttatcaaaaaagcatttgagtagtctattgattggtaattagcaagtttatgttaagcagccttgtcctgaatactttttagtatgtaccattaagcatttgcctttctcaactagggctaattaaaaaaaactcaaaacctcacattgtacacgttgaatatatataattttaatttgtgaattataccaccataaaactaaaaatctaattaagttgagtttgaatacattttagggaaaatacgataaagaaaattaggagcttaagaatatgcatagataaaaaataaacttgatagaaatattatttatatattatatattatgtatatttatatatatttatatataatatataaataataatatatatataaataatactatatgtatttcagaaaatcatataaaaagctgtgctaaaattttccagagagagagtaaatagttctcctgtagtggattaaaatgagattagcattggagtactagcgtaatacaacagatagagtctgaagtcagatctcaaaaatacaatatatttgctaagtaatgcgagacaagctatttaaagtttttggacctaaatatccagtctgtaagtttgttggaaaaaataaatacgctaatagagaacttaacttacagggagtgctaaattattacctgttactggaaaacataatatcagtgacattaaaagcttgagtgttgtagaacaatattttgaaatatcattttttgaagttatatacatatttatattactttaataatttgcacaacataggaaggaaagcttgctttgcacaggcaacatttttgccaaataatctttaaatcatcatgaattctcaattagattaacaataataaaattttattgtagaagactattttttcattaatatagttgtacatgcacatagggtaaatgtaatattttgttacttgcctaagctttataatgatcaaatcaaagtaaccagggtgtccataatctcaagtattatttccatatgttaagaacatttcaagtcctttagctattttggaatatacaatacattgctgtttatatgtagtcaccttactctgctatgaaatattagaacatatgtcttccaagtaattgtatgtttggacctattaacaaacttttctttattcctcccacccagagaaactttccagcctctggtatctatctataattctattctctacctccatgagatcaatatttttagttttcatgtaagaataaggatatgtgatacttgtttttctgtgcctggcttatttcacccaacacaatgacttccagttccatccatcttgctgtaaatgataaaatctcattcttttttatggacaaaaagtattctactgtgtatatatataccatgttgtttttattcattcatccattgatggacagaggttgatttcatatctttgctattgtgaatattgcaataaatatgagagtgtggttatctctttgatatactcatttatttacctttggacaaatagctagtaataaatagcttgcacctctggtctcagctacttgggagactaaagcaaggggatcacttgagcccccgaggttgaggttgcagtgagccatgatcactccactgcattctagcttggttgacagagtgagaacctctccctcctaaaaaaatccttaagaaatgtgttgatgcctggttcccttggtcagaattttcatttgatgtgttgagagtgtagcacagatgttggaatgaacctctcaagctgattttaatgtgcaaccaagtttgagaaccaccaaggaagagtttttatgaattaagattcctatactctatcctagaactaatacaactgaatctctgggaatggagtatcagaatcagatttgaaaaggtttccttagtaattctaaggactgagcagtttggatactcgtttgttagagtaaaatggttaggtacctagtatcaacataggcacccaacctgatattaataactaggaaaataaagggttggcgcctctgtgtttctttgttgaaaaatctgatactattcttagttctatgaaaacaattgaaaatttggttattatcaccttaaaagtacaaaacctatagatattgaaaatgtaattatttttctataggcatagttgaaatgattttgtaaatgttataaatcagtttctttataagcagttcatttacataaattttgttaaactgacatgattcactaattttctaaatataaatggttcagctctcagttatttttaaactaatgacctgtgttatacttactatttttaatgggcttttatgatgtttttaggtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatggaatagtgtttgcattttttgtttacctggtttaagatgtgcagcagaacataactagatgattacataatttctttttaaggcaattttataatatattttatttatgattataaaaactgcctttaaaaattcttacatggatatcaatgcagtttcactttttttattgtaatcttttttataattattttatacttgtctggcattgagttttattgggcttttggttttttggaagtagggtatttatcccaatttagaaaatttgtatccttgccataatacagtcttccatttttgtacccccaaatctttcatctgtcagaacatcactcaaaggtgaaaatatttcccacataaaattattctgttcctttaatgaaatgagtttcagctgtatataagtaggaaaacttccttttgttctatttgattcctttttacggatactttcttgaggctgtgattacacctttaccttagaggcactgcccaaaaagactcagctcttctgtaaaaatgctgttatgaatcatagcttcttaacttttacaacatagtgaggtagggaaagtaagaacactagagataggaattagaagcatggagaagtgaaccctggagcttcccaatggtgagataccaaatagttcaagaactagtaaagaagactacggaggaatagctagaagctaaatgaagaaagtatctcaaacaggaaggagtgatctgttaatgtgttaggaaagttgagttcttaggattaagcattgggtagagcaagatttgggaccttgactttgacgaacttggtggatgtcaggagtaagaggaggtattcaagagaatgttggagaggaatttaatatagtgagtattgaggacaacacttaaggagtcttgctttcaaggggatgtgagaaatgggttgttaatggagggtaatgtagtatcaaaaagctgtttattttgagatcgatgatatagtaggtttgtatgctaatgggactgattcagtagacagaaaaagcataatgcaggaaacagagggatattgctgaagccatagacctgggacacaaatagaagggttagttttaaagataggcccacaaacagctcattagtaacagcaggatgaagggcagattatggagttccagatgtttgtagtccagtagataggaggagcatgtcaaatttttgtgatattttctcagtgaaacaggaagcaagctcataaagagggaggaagtcacgaaggagtaaggaaggaaaaggagatgtaaaatgaatagataggagtgtaggaaagtaagcatactcttaggaaatctgtggtttatttaagtggtatcagtcaatgtggttctgtgtttttctccagttgagttcagcataggtgctatcactgaaaaagtacagaattcagtttaactaaaggtgagatttctctaggtgaataaaacagtcagtgatgagatgttgatacatttaagagaatgattataaaagagggatgtggaaagtagtctgggttaagtagtgaagtgagaaaataaagaaggttgagacagtggaaaatggaatgatcaattgtagattgcagtgtggttgaagatgcaatggacttcttgaggtgggaactagaaatttgggggatataaataagagaggggtgactgaaattgaaaatatgagagtataatagtatacaatattactaagtatggtatactaagtatagtagaatagtactaagtatagtagaatagtactaagtatatagtacttagtgagtataagttttaggatgtgaagaggggagtagcgtagaggcaaggtgatggaagcagatgagttcaagaaaatgagaacctaggagattgaaaccattatctaaatgaattctgaaatctcaagaagaactgtgctgagtgcttgtagtcattattttgtctttactactctgtgagaagacagcacttccttttgtgagtaatggaaagttctttaatatgtcaactgtaagatactttattacatttaattatctttagtaatgcatagtaataactaatgacctcagtaggattattcagtagatatgtgagctaaccccctgtgtcagacacctaagaggaacaactgatgtttttcaagacgaatagagggttctcatcccagggttttaagctgcaaaatatcccaccctatattttctgaaaacaaacgttatatagagtgtccacataaaagctaacaggaaatattacacacacacacacacacacacacacacacacacacagcattgaaaatgcatcaggaaagatataccctgtacccaacatgcacaaggtctaagcaatgaagaaaatctaggaaatcaaataagaccagaacatctatgactaatatataaatacttgaggcagttatatccatttaaaaggtgtcaattagacatgaaagaaaaaggccaggtgcagtggctcatgcttgtaatcccagcactttgggaggccaacgcaggcggatcaacgtgaggtcaggggtttgagaccagcttggccaacaaggtgagaccccgtctctactaaaaatacaaaaaaaattgctggttatggttgcacgtgcctgtggtcccatctacttaggaggctgaggtaggagaatcatctgaacccagaggtagagattgcagtgagctgagattgcgccattgcactccagcttgggtgatggagtaagattaaaatatatatatatacatttttacataagaaattttattttaatttttttgtaaattagaaaatagcaattaatatggtatttatataccagaatctttgaatatctaaaatttaagaagatgtgagcaatttcatgaaacttttcaaagcttagaaaaaggtagctatgtaaaataacaatgtatgttgtttatgggaacattagatgaagtaagtcatgaaaacatgcatagaaatgatcatataaacttgcaagaaattgaatgtcttgctatcaaaggaaaggatggaggtgtaagagactgaggtagaatgtgagaagctctgtatatattgtattttccttaaaaatatatatttaaactcgcatttcttgtttttcaaatgttcactctaatgaaaattcttttatttttcctgttacagtttttatttctgatctcatatatgcagtgtactgttgttcagaaatatcattgatcctccctgcaaatgaaatactctcatcctgttgaatttgagaatgtacacatgatttgctttggctttgaaatgtgagcagaaagaatgttttactttggggagttcccaattgctaaaccatgtgtcaaaatgaagtttttgtgacattacaaatggactaataagagtgcctttgttgatcctagttgaacatgagaaacttggttattgtaagccactgaaaaattttagtttcttttattactgcagaatagcctattctgtcctgattgatacagccacaacatttccttaagctctttgattttcatattgccattaggatgtagaatgccaagagaaggataaatcataggatcagagaatgttagcagtgaacgagactattggaatacattttttcaatggtttccagactttgggttctaagtaatcagtaatatttcgaaaaagtagtaaaagatatttcaatataaaaaataatgacatttaactttgaaaaaaaaaacctatcattgctaggcataatgggtctagcttgtaatcccaacaacttgggaggctgaggagggaggatcacttaaagtccaggagtttgaggctgcagtgaaccatgattgcatctccacactccagcctgggtgacatagggccacctcaacaacaaccaccaccaaagctatcattaatacattgttcctctgtctctcttcccatcctccttaccacttagtcttaaatctaatcttattaaacaatatctaaggaaaagataagaaaaatgatggttgcatctatactgaacatgtgttgacttttttcttgtcactattttctaaacaacacagtatcacaacttttgacatagcatttatgttgcattagttattataagtaatctgagatgatgtaaaggttatatgcaaatattatattttatataaaggacttgagtaattattactttaagtatccatggtggttcctggaacaaattcctcatggatatggagggaggaggaatcactgtaattaaacaaatcatcactttaaaacttaaaaccttttgcatgttgaatacagtcatgcaccacataaatgatggtggtcccattaagtttattatgccatatttttatcggaagtttcctatgtttaagtgtatttagatacacaagtacactgtgttacagttgcctatagtattcagtaaaataacatgctttacaggtttgtagtctaggagaaataggctaagccatctaggttaatgaagtccattctatgacatttgcacagtggcttaattacctaagggctttctcttcagaacctactcttgtcattaagcaatgcatgactgtagttggacaaaaaataataatgcaggcatacctttggcactgtcctaattcttaccagcatccatgattgcttaaatttgcactggaaagacttcaaaaaacagtgatatattaggacaatatatttccagtacatgacaaatgataacaacataagaactcgaaacactcaataaaaaacaaaaaataaagcaaaactagatgggaaaaggaagaagcaaatttcaagagaaaactcaaaaggccaaaaaatgtgaaatgatgttcagccttgctagtaattgggaaaaacacaaatcattttttttttttttttttttgagatggagtctccctctgtcacccacgctggagtgcattggcgtgatctgggctcactgccagctccacctaccaccttcaggccgccattcccctgcctcaggctccagagtagctgggactacaggggcccaccaccatgcctggctagttttttgtgtttttagtagagacagggtttcaccatgttagccaggatggtctccgtctcctgacctcgtgatctgcccgcctcagcttccgaaagtgctgggattacaggagtgagacacgtgcccgacccaaatcatttttaatctattagtcaaaaattagagctatgataatattaatttttggtgggagtgtggcaaaaggtactataatatactgctactagagagtaaaaattgataaattttgtaagggcaattttgcacaatatgaaaatataaaaatatgcttcatgtttaccatacatttatctagcatacagaattacccatgtgtaaacatgtatacagatgttcattataacacttcttataaaaacaaaatatttggaaataaatgttcatattaataaggcgcataccgtatgatcttagtccagttagaatattctgttttatttcaatcctttaaaagactcaacttctgactctatatagacgattaaaaaaagaatgtgttctccctttgtgcatttggtcaggtaaattaaaaaatacaccacatgctagccgcaccaaactggaataagcctttggaaagaagttgtccttgaagcttgtatctgacattgtagcaggacgagcctcagacaaaacctctcagacactgagttgtagaaggaagggctttattcagctgggagcatcggccagctactgtctcaaaatctgagctcccggagtgcacaatttctgtcctttttaagggctcacaacactaaagatttcacatgaaagggtcgtgattgatttgagcaagcaagggatacgtgacaaggactacattcactgctggtcagggagaaacagaacagggcagggagtttcacagagttcttttatacaatgtctggaatctgtgaataatatcagcttctaaatcataagttgatttttagctactgggtttaggccaatcaggcccaggcctggtttcaggcctggcgctgggctgcatgtctttggttgtacttcctggttgtttttactgaatagaaaacaatataaaacaaggagagggtctttgtctcctctcaatatcagcactggattgtagaatgtgttgctgattttgaccttgtattcaagttaactgttgcccttggtatctgtacatatctttgatttcagtctttactacacgtggcttggtcacttcatggctaaaaacatgcttgtggaagaccagtctggctcggtgagtctgtgcggccagcagtctctgatctgtacagggtattaatgtgtcagggctgagtgttctgggatttgtctagaggctggtaagggcttctggaccacttgtttctgtcctgtcagtctgtcagggttggaaagtccaagccataggacccagtttcctttcttagcttacgttatctaccagagcaccgtgggctgttacttaccttgagttggaaggggttcgcatttatacctgtaaaagtattcatccttttaatttatgtaaagtttttttgtatgccattctggatctttaaagagatgacaacaaattttggttttctactgttatgtgagaacattaggccccagcaacaggtcactgtttaaggaaaaataaaagtgctgccagaacctaagaaaaacattaatatctaaaaggtcatttagatgatttccatgagagactttttgatgttctttacctgttaggattattattgataatccttttcagattatgaataaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtgggtatgattcatagtatcaattgcggaattcactgtgcttgtaggaaatagtattctgatcttatctgtgaagcttgggcaacattttacttcacaggtaagtattctaagtaaaagagatttctgagggaaaatctatgtagtattcttggcaactttatattttgtttctgagataatctttcttcaccaagagccctccaatgtgctgttaatattttcaagagatagctgcctataccaagattcaagaatcttttatactattgattagtttctagaacattcaatgatacacagtaagacagaatttggtacttatgaagactgtttaatttgtaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggtaagtgaattctagtttcctttaaaaataacagacaggaaaatggtttctctctcttctttcttgctccttttcagcagaaaattttccgtattttatttttttaattttacttcataatttaaaactcaaaattaactgtttatttatgttcaacttttgtgaatatttgtgtgtgtgctatctactaaagaggtaagttaaagtttaaatcagaatttgcttctaaagcaaaacatcaaattttaacccttataactgttcgtatttcccggaaacaatttactggttaggaagtataattccagttacaatgtttgctatcatttttaggtgacttgtgtctccatccgtaattcttgggtttttcatggtgaatagctagcttctctatttaatgaggagcataaattgagattaatagctaccttgtttgtcttcaaaagcttcatagagagtacaggctttctcctggtgacccactgaaatttccaaaacaataacctttccactctcatctgagttttgtcttcccaaagtgggctttttgcatttcctcctatttatggtagtttctggtctctcaatttatcattcctataaatatttgaccaagtgtctagaaggcatgtaggtgtttagttcacattactttcctttcacagttgatttttgatcttgtaggaaaataattataagatatcatgaaatattttggagttttattaacatactataaacttgcatcaataatgctttaaatttctacctctctgtaagtcacactgaagtagaaactttgttttctaggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtaatttttttacgagagtgatctgaataaaagagtaatatatgccttttcttgtagacatgtagctaattgaatttcatttaaaataggaatttagatctcttagggacagaagttaacaagtttgactactttaagaaactcaaatccatatttaagaactttcaaatattgatttaagatttttaatcaatacacatttgcccacttctaagaagttcccaattaaaaatctcatcgactttatttcctaaattctctattttctattagaaaatatttcaaagatacatctgtagtagaatgtgagcatccccagtgcccaatgcaaggaagtcactatagaatatctcttgaggaatcatggaataaatgaataatccaatggattctcaggagaaaaatgaggttttatgaatcaatcataacatttttacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacttatatgcctataaaatatcatcttattcgttagaaaattaatggaagatttaattaaaaatgcaatttctgtaggataaggaatgagacatttacataaaacagtgttctttaacctcctcttcttcacatacagcatatctaattctttatcacaacatgttttatggaggtacacagaatgtaggatactgataatagttatgtctttactttctttggataatgaaacaagttaatatttatcaaggaatttcagtcgatactaaatgttttattagtgtgagctcttattattatcattgatgtagaagactaaaaattaggtaagtattttcacaggacaacaggtatctttgacattatgcttctttcaatattgtagcctatactttatcaaataaaagaatataagaatattacctgttgagataataggaataagaaaaccattttgcacatttcgtgtaacaaacaggaccaggcatggtggctcgtgcatgtaatctcagcactttgggaggctgcggcagggggattgcttgaggccaggagtttgggaccatcctggacgacatagcaagaccctgtctctaaaaaacaaaacaaaacaagacaaaaagaaataataaatagcttaatttattaataaataacaaatagcataaagctatttttatataatattaacttattggttaaaatgctttaaagtccttacacaaaatgttattgtttcctaaatttctactaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttccctgaagtatttcatggatctattagtcatactacctcagtgtgacttatcttctggaacattcttattcagacaactatcaaagagtcaattgtgaatgataagtattctagtgccctaaactctaatcaatcatcttttgtatttagagtgtctgtcacaaggcaatatgtctaggaacgctaaacataccctaggagttttcatctaagtacgagatgaatatactggatttgactgatgtttgcatataatcttttaaagccaggttattattaaaatgatcctatcatttatgaagtatgtacaaagtttccatcctgtagaatttacatgtattatatgaattaaaaatataaaaaatatttatattataacaatacagtattgaagccttattttaatctagtttgattaaactagattggtctagtttgattaaactagattaaacttcttggtctaggcacatgaatattgttgtggggaagagaattctgtataatgtgatatggatattgatccttctggagtgcctctaaatgataatgtgctgaaacctctgaaaggaccttttttaataacaaaaatcttatatttgtaatatgaatgtaagtattccatacatgtatatacaaatatggaccatacatgtagattacacatgtgtgtgtgtttgatgtgtgtgtatatatatgtgtgtgtgtgtttgtgtgtgtatatatatatatatctcttacaggaaaagcatttaattagagaaagaatttaatcttcagatgccatgccttacagagagagatgcacagttaagttactctcaaactgttgtgaaatgatacatcaacgtatatcttatttttcaaaaataggaactggggagaaggttggggtttcgtaccttctgacagagcgcttgtctttgtggataaccatgacaatcaacgaggacatggggctggaggagcctctattcttaccttctgggatgctaggtagaaaaccaagttctctatttttttaacacgtcttttaatgatggcaagaatattctgacatcctatgaaaatataattatgtaacttccaggctgtacaaaatggcagttggatttatgcttgctcatccttacggatttacacgagtaatgtcaagctaccgttggccaagacagtttcaaaatggaaacgtaagttttggagttgttcaatatatccttttctgaagaaaaaggaagcaatcttattctaacttaacatgacaactattaattatatatttattcaacaaatatttaattgattgtaaactggatacagggctgtgattttagtaatgtaggttatattaaaggagtaaaatttatattctccattgacaaagagtatgcaagctgtttcagagatatgacaaacatccccttagcccgcagggaaacaaaaaacaaaaaacagaaaaacactcaaaactaagagctagacacagggattaaaatatatacttcgaataagtacctacctcagggctgataggaagattatacatgccaacacttttagagaacttaaaacatcatctgcccgtagtgagaacaatataaatgtttgttaaatacttttaaaaagttatatggaatagaaagaaatgaatcaattgagctgagttaaatagggaaagtatcatataagaggaaggaaatgatatgtactaaagaatagaaatttagagagtattccaagaaaggtaagaatgagaaaaatatttgggagtatggtaaagacattaatctgatgagaagtttcaaaaaggaacagagaaattacagtgtaaagatatttggaaagctagtagaaggttttcttttaaactaaagggttcagaaacagcatcagagacttcagaactaaagcagaaattcctccttcctatgagtcacacggatatctagctagctttttttagattcctttcagtttgagaagtccgcactttgtatagcaatttattctattgttaaacagctttaatatttagaaggtgtacttttatattgagccaacttcttttaatttctactaattggtcttatttctgatgttaggagtcatagagtatttttattttttctattactataacatttccactttgccaggactgctgcatgctaaaaactcttagttttgttcacttttcaccatatgacatgattctaaggtcaacactgaaaaacttcctaagattcctctggattttttaatgaagattttttaaagtgccaatcagaaaaccataatatgaaaaatgtggtcaatttataaataatgttcagatgtattgttttgtacatttatctaaaaagaagcatgaatgattctaatatttattcagcacatgtcacattcaaggcattttcacatatattacttaatttttatagcaaaaaaaccaatattcccattttacaaatgaagaaactgagacacagagatattaagtgtattgattaaattttctcaggtactagtaatagagcctatgttttaatcctggtgtttctagtactaatgcccttcccatttcaatgacattgcatggcttaccacgatgttaagaagctcttgcaggccaggtgcagtggctcacacctgtaatcccagcacctagtgaggcgaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgatcatgccactgtactccagcctgggtgacagagcaaagaagcctttgcagttctttggaatgaaaaggagaggataaaaatttgttaccttgtttgaaatatgccagaagaaaaccagaggatagagagatgatgaagacccagtaaagggctataaacattaatgaaggcattggattctagataaagtcactgaatgcagagacacaagtaacaggattggttgggtttggtgtaaaggagaaggaagaggtaaatacatgcatagtaaaatttggctttttcccccctacttaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccactgcattttatttaaaacagttgaagtttaagaatatcaacgttttatatggtattgtgtttttaggaacatggttattttccgcaatgtagtggatggccagccttttacaaattggtatgataatgggagcaaccaagtggcttttgggagaggaaacagaggattcattgttttcaacaatgatgactggtaagtaaatatcaattaaaaataatattttgtaccagtatgttcttggtttattcttttttttctctgttcattgacttttatcatatctgaaaaatcatgtagtcagtggagcaagaagacaatagagatcaaaattgggcagaagcaaaaggatgatggctgttactccttcgttctttttttttcataagtgctttctgttgtaagcagaatcctttctgtgcacccttgcagtatcatatgcatatatatgatgcacatgcatatgctcacctacacatgccacaaaatcaatatataaaatcacaatcaatataaggattgtgaaatcattaaaaaaaagtgtcttataatcctgcttttttaaccatggagaaatgctgcctaggtactaaaatatctttatttctaactctttttctcaatgactgctctacgtagttttttggtacactttcttcacttctctgtctccttgtgacaaataacatttttaaagcacatgtatgaataatatgtatcttgtggttactgttttgcttcaggagatttgagttttatttttgaaacttctcattattggcctttcatctgtgattcttatatgctttacctgaagcataaatgattatctaagatatagctcagaagaccttggtgtaaacagttgaattgtccctgtccaagaccaactgacactcatacttagctcactctagtataaattatatttcactgatgaaaagtaaataaatacatcaatatacaagtcaagttgatctctttcctgccaaaaaagcccatgtctagttttttaatttctttcttttgtagatgaaaataccaaaataagtttttgtgaaaaagctttatatttcaaactatcacttcttcatagaaatgctagattatttttatgtgcatcccaaattcgttttgatctcatgggagaagaaggaggttaaaaaataataccctttaaatttttaagagtaattggtattaatttcagttgagaacaaatttgattttaccaaggtagaacttttatcaaagtgtgaccgttcctgccaatcttcagtgatattcttcaactttgatgttttggtaatattttcactactaaccaggaaattgctaggttttctgtaaggttacttttggtcctagaaagctatttccacctactagagaggcatatgggttttcttcttaataagacttcactgcttaggtttgtttctacaacataaagttatgctgtttatttgtgttagtctgtattcttgattttcattgtattgaagatcaaccttaaattttattttacaggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaatagccaagtgtgtttcttttcttacatgtacagcagtacttatatttcattaatttttactaaaagctctaattagtaattagaggttcaaaaaagttgatagtgtgaaacacaattccaggttacacagaagttatttattttggcaaaaggatgtctcagaaattttaaaactaggcaacaacctttactcattaagagggaagacttagctttccaaacagtctgtctcctgtctactcttttctctccttggcagtctaccaacaaggcaaaccaaatatttcattattcttctctattacatgaaaaatctgtacaagggaaagaaaaccaaattttacccttacattggtttcaaaacattcctttttccataggcaacgtttacatttttatgcctttttataatcttttatgacaaacacattttactgtttttacacacattttacacactttgcatgtaaatttatttttagttgtcttatttacatgttttaatggtaaatcttaactttgccattttagttaaaatggtaactttaatgtaaaacctggtaagttttttcaattatgtactagatgcagataaagtctgactttttccatcctagttaggggcatggttaatttcatatgtccccaggccttatcaagttgtaaagtaggcagtatacaaccttgaaacatttagcaaacctggtatctaacttatatgatttaaacctcctatttacgtgttgatgatatttgcattttccaatttgatctttaaaacaatttttatttcttagagatgaaagtcacataaactaaaaggcattgcagttttaactttcctctaaaatgtttgatttaagtgcatatttttatttcaggcaatcagttatagctcgttacagacatcacacacaacacatatatcattacacagacaaacagaagcagatccagtagttctaagatttcttcctgtcccacttcctaattgaattattggcttcccagtagagccctttaagagcagggatagaaaaaccatgaagtttctagggcctaatcaacttgtatagctgtaagacaaaagcagattttgagtgggatctatcagcctctaaattctgggattccatcaggaaaacagaggtttctcccaaaatggaatccactgtgccttttctgtttttcccaaaaagtttcaggccaccagacattaccttgggtgcatcaagagtggaaagacagagcggaggacagtaattcagccaacagaaaaattcttttcaagaaaaacacaatccaagaagagaaaaacatacgggccttttaaatatacctataacttgaatatccacttttaatcaagctgagcactctttcagaaattcctttgaaatcttctgttacctgactttagctaaatcaagcaggtaatatttctggcttttgaactttactaaaagtaacatcacaggtgaaaacaacaactctcaatcaggttataagttaactgtgagtattcaagatattttataagtggtggtaagcagcttttactagatctagaaactttaaaggcaatttagagaaaggaagatttcagaaaggaaattagagttgttcatggaggaggaagagatgattaaaggtcatacagctattaaattgaaagtattcatcacccaagctaggattgaacctgggccaccattgtaaaatggcaatggctaaaaaagtcctgccacaaggttacaggttatgctcaagacataaaacaagatagaggcatgcagcaaagtttgttacttaccagtttatgtgggtgacttgaatagtgagcttatggagtcccaggcctggattccattccaacgtattccaacccgttccaagatgggttgttacccatgcagaaaacggggggaatataaggtgtcccttagtctcctttctccttttgaagtgacccaggatgaagcaaaagattacaggggtgtccctgttctcctctttcctcccatctcctttgggtcccggtaaccatcataggtgctgtccatggatgaaagcatgaattgcacccatggatgtggaggtgctagctggcaggagtagtcatttttaccagcacaatgcctcctcacactgctcttctgggttcctaggcctcccaggagattctacagtagataaagttgggtgagacactttaatagagggagtgttttaaccctattcctgcctcctctagttatggacctggaaaagcagtgcattcccagaaaattttatccattgacatttaaatataaaatcccctttctgtttaaatgccaatgtggttggaagcagaacaggtgtctcaaaagaacatatagatttaatggctgtcctccttctgatggaaacagcactaaggctagaatttgtctctcaagggtggcttcctcccaactgttgaatgcggagtttttttccttagaaatggggcatagggtctgcttgctgttagaggaacacaaaagagggagaaatctgggcattagaattttttggcgaacggccaccaagaatttttacggagaaaaatagcctatctcatgaggtggtgctgtagggtctgaaaagttatgtaaaatctgtgactctaaattttttccaggaagaagttagaaagagaggtttggggtttaacaggctgtcactgtatatgcctcccagcagtagaaaattaacttgtctcattaataaactgttcaaattcattcagcagtgctgagcttttacatgaaggaaaagcaactgaaatggagagggatgagggtattcacttggggtgaaatatcttctcatagagtgccatgaatgactgctattgcgggacaagaagcacttactaggtgaaggtttagactgaaatcttgaaatcccctggtattttgtgtgtctgattacctttccaaaggaataaaatcagatatgtatccatctcagtgagcagaggggtgactttgagtagaatgggaggaaggtttgttctaagtagtttcccgcttgcattttccccagtgatttcaggggcccagtatattttcctttcacacatctgacaagggattaataaccagaatatctacggagctcaaacaactctagagggaaaaaaaatctaataattgcatcaaaaagtgagcaaaagatttgaatagacatttctcaaaagcagacagacatatggtaaacaagcatatgaaaatgtgctcaacatcattgatcagagaaatacaaataaaaactacaatgagatattatctcaccccagttaaaatggcttttatttaaaaaacagacaataacaaatgctggtgaggaggtggagaaaagggaaccatcatacactttttgtggttatgtaaattagtacagctgctatggaaaacaatttggaggttcatcaaaaaactaaaaatagagctatgatgtgatccaggaatcccacagctaggtatatacccaaaagtaagaaaatcagtatattgaaatgataactgcactcccatgtttattccagccctgttcacaatagctaagacttggaaactacctaaatgtccatcaacatatgaatggataaagaagatgtggtacatatatacaatagagtactattcagccatggaaaaatgagatcctgtcatttgcaacaacatagatggaactgaactgtacattattatgtgacgtaaaataaaccggcccagaaagacaaacatcacatgttctcacttatttgtgggagcagcaattccaaacaatggaactcacggtcatagagagtagaaagatggttactagaggctgagaagggtggatgggaagcaagtgtgaatgttcaatgagtacaaaaaacagaagaatgaataagacctaatatttgacagcacaacagggtgactatcgtcaataacaacttaattgtacaatttaaaataactaaaagaatataattagattgtttgtaacataaaggtaaatgctcgtggtgatggataacccatttaccctgatgctattactacacattatctgcctgtatcaaaatatgacatatgccctataagtatatacacctcctaggtaccaacaacaattaaaaatttaaaaaagtgtatccttcccagtgaaccgaaatattttacattgatcatttttacattatcatagtgtgttggaataatcatagctttggaaagaaaaaaaataaatgtaaactttcaaagatggcaggagatatagatctctctttctttagtggatttaaatatgcaatttgttatcaacattgcactgacaatttttaacacaggccatattctggaaatgatatgattataggagttataggaaaaagcattttttcatactgtgattatctaggctatgaggaaaagagatatttcctctatgatgtctaatttagcataattattctttttaaactatatttagatttaattaagagatacacaaacaaattacttttagtagtaagaagagtttttaaaatgttttgtgtaagatgactatgtagtaaagaaggttacaaacctgctttttaacttagaaaaataatctcaccttcttgccccatggaaaattgaaatgttatgtggaacccaatgtacaaaaactctcagtgaggatttctgtcttaagtttcaacggattgaggtgagatcagtgcctgttccacctttttcctccctgtcctaggtgacttgataacatttatacagccataaaattttgcttttaaattcaagtatagaaaataaactttaaaatgtgatatttttatatattttaccttaataatttatatgggaaatatttttgaaaggttaaaaaattaaaatttttaaaagagtatagtgaaataatctaatcacatgtggaaattgtgttactatttccccaagcattttttgtacatgtaattgaaaatgagttgaatgtaactcataagtagtataaaagtgtttaatatttaattttctgctgcagtaatgtgacataacaaccttaaattcttggtactttaaacaagatattttttttctcccaaatttctaggttatttaagggcagttctgcttcatattgcagtttgcctgggctttactccaggctgtgtgttggagttaggtctaatctattgtatccctacacatcccacttagaaaagctaacaaatttcctttggacttcagtcagttcgattgtatttgtcattcaaaagccaaatcatttatcctaacaccaacggcttatttatttatttatttgtttgtttatttatttatgttttagaaggagtttttctcttgttgcccaggctgaggtgcaatggcgcgatcctggctcaccgcaatgtccccttcccgggtcaagggattgtcctgactcagcgtcctgagtagctgggattacaggcatgcaccaccatgcccagttaattttgtatttttagtagagatggggtttcttcgtgtggatcattctgttctagaactcccgacctcagttgatccgccagcctcaggctcccaaagtgctgggattacaggcgtaagccaccgctcccagcctaaccgattgcttcttttgttctgtagtcttttgccaaaactgttattctctggactcactttcaccttctctcacacatacatgtccctcgtgtccctttgtgtctccagggtcttctatttccacgtaatcttaatttttcatcacatcctggactcatgagtaattaatctgttattctccctgaaagtgcagccttgttgaatagaatgtgttctttaaacagcagctttgtttctcgagtgaggtattaacttccagatttaggtgaaaatgagttccaagttttatgtttcattgtgtgtctaagactgacaccgtttattaccgtggcacttacagcttgctttcaatgcctccaaattctctatctgaaaggctgggtaccatatctcatgtctgaacatagtcctcagaatcatgcagtaccagctatgttccttctgtatattatggcttccgaggtgcctgttaagcagccaggtgaaattgccttttaatcaatataggaaccagtctctttcctggtgatgctaatgctttttataaaaaggccatgctgtattgaagttcttctttcaggacaaaaccactaatggaactcatctacctactgatgggtggaagctcttggtatgccaaagtcttgttttgtttgtgaagaatctctttccctcaacagtgatgtgctacgttaggtctcaaatcattgttgcgttttaatccaaatttatgacaaagattttcagtttgtatgcataatttccttctctggccttaaccatcagtctgtggacttgccaagcaacaacaacaacaagaacaacaagtctgaggtcaagagacactatttagatctcagaatcatttgttgtcatttatcctttgataaagttttgcctttctttctttatgagtatatttcctctcatggtttcccaatctcttgagaaaaagaaagttcttgcctcttgcagtctttctcattagttgaattataccagcagttcagcttctgatcctgtcgagaaatccaccatgaagaaataaaacatttctgattacatggattacgtttcctggattcttataggcattaaacttagttctaggatacaaccgcatgatcttctcttattctcagaacaagaaatatattactatatacattacagtttgtatatattgcagtttatatagagtatatgtatatgtactgtatatatatatgtacacatatatataacagtaaaccctgtaggcaagcaggaaaacttcagaattctcaatgaatccatcattagctgttagtaatgacaacactattagaagtatttcaataatcaaacattgttgtggtctgtatgtgcacccccaaaagtaatatcttgaaattctaacacctgagggcatagtatttggaacttgggagtggaattcttttttgtgctattatgaataagatgcttgcctcttccatcaaatgaggacacagccacaagttaccctctaggagctaggaagttagtcttcaccagacacaaaatctgcttgattttgaatttagtctcctgaactgtggaaaataaatttctgcttttataagccactcagtttatgctatttggttatagtggcccaaagagagtaaaaagacacattatttacctcctttgtggactctctggagttgttgctttaaacttgctttagtgcctaacactgctccaactccctgtcctttagcacacacggataaataattctgctgggaactgacatgtttcactcaggcatccaaatgtatttattatgttgtcaaaatatatagcacttgttacaatgtttccatgttagacatattttgagatatatgccttaacactgtgctgtgattattattaatatctagtaactaatcttaccatatctaaactcaaagttttcacgataacactgccttattagggactgaattttttaaagtatgaagatcttacatcaagtccaaattgattcatctgatagtctcgcagtaaaatcaacgccacagaattatctattctgtttcttgtcttgttgtagctgatattctgtgattggacatattgctaatatctattaaccttagcataaaatgtcatattgaaattgaagaggaatattggaacttggctaagaaagattgcttttcagacacagtgagaactaaaatggaccctctgttcctggaggtatattttacaaaaattgggtgctattataggaattctgtacaattctatcttatgcacttgtgttccatcagtgtcaatcctctctgtattttaaattgactatgatttctttttccatctttctgtttgtcaagtattcttttgctgaaaatttgttattcatgttccaacagaaaatagattttttttcttttaactcattggaaagaatatttagagtctttagtgacaaatgacatggtataaatgaaaagaaaatactgacattgtacttgagaaatactaattaattgggagaatattaattaaaagacattgtttaaatatttctatcacaaattgacagcagaacaatacacaccaccagcaaggtataatagtagatatgagaggtaaaatgattaattagatattgcattttctccagaaaacttattatttagtggaaactggccaataatttcttaggccttaggataattttacctttgattctctagttaatcaaaaatatataaaaatattaaccaaaagtatatatttttaaaatacctacataatctaatgcagtatgtttcgctctcttcttgaagtgaattaaattccttatcactgaccataaaatttaactacatagatgattcttgtttaaaatagttaaaagtgaacgtaaagatcagttttggttttccttttcttacccccgttttttacacttatatttgcctgtgtcattcatatacttttagaatccaaaacaataattaaaaacataatcatttggttttcaaaagctttttgcatctctagaaagttaatatagagtcttataaaacttttagctaattcaaaaacaaatcacacatatataattgaagcaaactttgtttggtagacttcttcgaaccacagaaatttcagttatggcatggtaggtcttttgaaatgtttcattttttatatttggagatgcacaacaaaagtctttccactccaactcccctttaataaaaacagaatgtaacaaaaatatcaaaatctgtaggaaaataacccattcgtctatgttaaagctatgagatttccagcccaaataaattataagaaccagtatagaggccgggcgcgatggctcacacttgtaatcccaacacttttgggggctgaggcaggcggatcaagagttcaggagatcaggaccatcccagctaacacggtgaaaccccatctctactaaatatacaaaaaaagtaattagccaggcacagtggcgggtgcctgtagtcccactactcaggaggctgaggcaggagaatggcctcatcctgggaggtggagtttgcagtgagccgagatcacaccactgcactccagcctgggagatagagtgacactctgtctccaaaaaaaaaaaaaaaaaaagcatgtagaaatactaatacagtgaaatctggactgatatataaagaaaataaccaacagattttgtctatggcacaaaattcttagaaattttgagatctttagccttatagacctaacaaaatatttattagtttgaacagtgaggtactgggatatgctgggctttgaggctatacgcaaatctaattttagaagtcaggaactgttgtaagcaatagcaaagaatatgtttgatgatcagcttggcaattgttgaacaagcttcattcagcactgtgaggatgtaattaaagcagttgccctgcaatctattcactctcttcactggcgaatggcccaggcataagactagaaggaagatgaactggtttagtctctttgtcagctgaaattttggtgaaagagactactgatatttttctaggatgaagggatcttatctctgaaataccctttgcaggttattcctggctgaaacaaatgcacagatcctttcttcttgatcaattttgctgtcgattctcattttacattctttatttcatttattttattctttagctccagaatttttgtttgggttccattttttccatctctctgttgaacttctcatttggtttgtgttttgtttttttcaagttttagttgaattgcctatttgtcctcttgtaactcattactttcctttaaaacaattatttgacaggaaaaactgcacaaaaatagaaaaatctataaatcacatgacgaagaattcaaaataattattttaaagaatttctgaatttgcagcaaaagtttgctatagagcaacatgaaagcacagaaaagtatgaaactcattgattaaggtaaatatataaaaaatgcagaacatgctaatagtataatagtggtgtgtaaatctcttttattgctagtatgaaggttaaaataccaaagtaataataattatagctacaataatttgttaatagatacagaatattaaaaatatataatgtgacatcaaatatataaaatatggtgggctgagtaaaagtatagggttttgaatatgatcaaagttatcagtttaaaagagtttgctccaattacaagatagtatatataagcatcatgctaatcaaaaagacaaaacctatggtagatacccaaaagataaagagaaatcaaaccatgtcagtacagaaaatcatgaaatctcaaagaaagacagcaagggagaaataaagaaactaataatatgttaaaaagccaaaaaacaatgaacaaagtggcaattgtatgttcttacctatcaataattaccttgaaggtaaattcattctattctacattcaaaacccagaatggctgaatggattacaaaagaagacccatcaatatgctgcctacaagagactcacttcagcttcaaggacacatatggagtgaatgtaggggatgagaaaatttgatattccatgcaaattaaaaccagaaaacagcatggatagctatccttatatcaggcaaaatatactttaagatacaactgtagcaagtgataaagatggtcattaaataatgaaaaagtggtgagttgattaaagggatgaaacaattataaataaatatgcacttaacattgaagcacctgaaaatataaagcaaacattaatatctggagggacagatacacagcaatcaataatattagggaaataggtaaccttattgatactgttgcaattatcaatactccaattgcaacaatggatagatcatttagatagacaatctataaggaaaaaaaacattagacttgatctgcactttagaccaaacggacctaacagatgtatgttcacatttcatctacagctggagaacaggtgttcttctcaagctaacaagaaacatcctccaaaatagagcatatttgaaattacaaaatgtcttaatacatttaagaagattgaagttgtatcaagtatcttttttaaccacaatggtatataactagaaatcagcaacaggaggaaaactggaaaattcaaaaataagtgaacataatgcaatccttaacaaaaagtgttttaaaaaggaaatgaaaaggaaaataaaaaatcttgatacaaaaatgaaaacacaatactccaaaacttgtggcatgcagtaagaccgtgctaagaagaaaatttgtatgacaaacacctacattaaagaaaaaacatctcaaataatctatcattaaacctcaaggaactagataaaaagaagagcaaactaagcccaaagctaatacaagaaagcaaagaaatatcaaagcaaaataaagaaatagacagtagaaaaataatagaaattgaaagactttctgtgttcatcaatgggagaaatcaatactgtcaaaatgctattggacaaaacaatctacagataaatgtaatccctatcaaatgtccagcggcatttttcacagaaacagaaataaatactaaaatttgtatgaaattacaaaagactataagtacctaaagtgatcttgtgcaagaagaacaaacaggaggtaccacacttctcactttcaagttatattacaaaactacagcaaattttatatatactgacatgaaaacagtgacatagaagaatggaacagaatagaaagcctagaaataaacctacaccaagacggtcaaaaaatcttcaataacatgcccaaaatacctaatggagacaggatagtctcttcaataaatagcgtttagaaaaactgcaggcccacatgcaaaataatgaaatttgacagttataatatgcacaggaataaattgaacattgaaaaggaatttaaacttaacatctgaaaccaaagaatccctagaagaaaccaggggaaatcctccttaagattgaccttggcatgattttttggctatgaatctcaaaatatagacaagacaaacaaaaataaacacatggaactacaccaaagtaagaggttgctgcacagtaaaaaaaaaaataataattaattaattaattaattaattaaaaaggtcacccatggaatggtagaaaatacttgaaaacaatatatctgataatggattaatatctgaaacagataagaaactaataatcagaaaaaaatcctgattagaacatgagcaagagacctgaacagacttttttccaaggtagacttgcacatggccaacacatgaatgaagaggtgcacaaaatcactaaacaagtgggaaatataaactgaaatgaaaatgagatgtcacattacatcttttaaaatggccaatataaaaagccaaaagatagatagtgttgacaaggatgtatcaaaacgagaatgcttatagagttttggtgggaatgtaaattggtacaaccattatggaatacagcatggagggtcctcaaataattaaagacttaccatatgatgcagcaattatacttttaggtataaatttatatacctgtgggtgtgttggctcacacctgtaattccagcactttgagaagctgaggcaggcagattacatgaggtcaggagttcaagaccagagttgccaacatggcgaatccctgtctctactaaaaaccataaaaattagccaggtgtggtggtgggcacctgtaatcccagctacttgggaggctgcggcatggagaattgtttgaacctgggaagcagaggttccagtgagccgagaacttgatgccattttatataattatcctttcacagacaaaagaaatctaatcactatcttgaagagatatctgcattcctgtgttcattgcagcattattcccaaaacccaaaatatggaaacaacctaagtgttgatagatgagtagtatgtgaattgtgatatctatcatctatctatctatctatctatctatctatctatctatctatctacaatggaatatcattcagtattaaaaagaatgaaatttggccctttgtaacaaaatgaatgaccctagaggatattatgctaagtgaaataagccaggcagagaaagaaaaatactacaggtacaaccatgcaaacttgccattataagatgaataagttagggagatctaacgtacaacatggtaacaatagataataataatgtatgctttaagttcatggagtgtagatcttaagtattatcctttcccaacatgtgataactatgtgaagacatgaatatgttaattagcttgatagtgaaaatcattttaatatatacttgatgggcgcagggtgagaggagagtgagggtcaaaacactacctgctggggactatgctcactagctgggtgatgaaatcatttgtacaccaaaccccagcaacatgcaattacccacgtaacaaacctgcacatgtacctcctgaacctaaaatagaagttgagaaaagaaaaagaagatatcagtttcctatagggagctccaggtttgttccaaacagtagagagacaaacctatcaaggatgaaatatatacaagagtaggcacaacttaaacaatgtgtgtaaggcaatcaattctatataactcagcaactcctaggcttcttatcaaataaaatcactgatgtgtcataacttctaaactaaaaacaacacaaatgcccattcacagtagaatgaataaataaattacttttgcttcccacaggggaatacggcacagcaatgaaacaatgatctgctgctacacaaaatgtagatgattcttacaaacttcaactgagtgaaagaagtcagactcaaaagaatacagatagcaactttccatttatatgaaattgaggagcagggaaatccatcgtgatagagttcatgataatgatgacctttggtgagtaactggttgagaaagtgcaagagagtggttgtgggagctggaaatactccatatcttgcttgatttgagtgatgatggggatatatacacttataaaaattataatgctatatgcttaagatttatgtattttactatttgtaagatatatattagttgaaaaaatgctgcagtgtaaaggaaaccagtaaaaatatgctacctagaattgtagatttgtttaacaaaaaagcatttgagtagtctattgattattagttagcaagtttatattaagcatcattgtcctgaatactttttagtatgtaccagtaagtgtttgcctttctcaactagggctaattaaaaaaaactcaaaacctcatgttgtacacattgaatatatataattttaacttgtgaattataccaccataaaactaaaaatctaattaaaatgagttcgaataaattttagggaaaataggataatgaaaattatgagcttaagaatatgcatagataaaaaataaactgttgatagaaattttattgttatatttcagaaaatcatataaaaagctgtgctaaaagtttccagagagagagtacatagttctcctgcagtggattaaaatgagattagcattggagtactagtctaaaaccacagatagagtctggagtcagatctcagaaatacaatatatttgataagtaatgagagacaagttatttaaatttttgggacctaaacatccagtctgtaagtttgttgaaaaaaataaacaggctaaagagaccttaatttacagggagggctaaattattacctattattgtaaaacataatagcagtgacattaaaagcttgagtgctgtagaacaatatattgaaaatcactttttgaagttatatacatatttatattactttaataatttgcacaatgtaggaagaaaagcttgctttgcacaggcaacattttgccaaataatctccaaatcatcatgaattctcaattagtcagattaacaataataaaattttattgtagaggaggattattttttcattaatatatttgtacctacacatagtgtatatgtaatattttgttacctgcctggactttacaatgatcaattcaaagtatccggggtgtccataacctcaagtattatttccatatgttaagaaagtttcaagtcctttagctattttggaaaatacaatacattgctgtttatatgtagtcaccttactctgctatgaaatattagaacttatgtcttccaagtaactgtatgtttggacccattaacaaacttttctttattcctcccacccacagaaactctttccagcctctggtatctatgtattattctattctctacctccatgagatcaatatttttagctttcacgttctattcttagaataagaacatgtgatgcttgtctttctgtgcctggcttatttcacctaacacaatgacttccagttccaaccgtcttgctgtaaatgataaaatttcattcttttttatggacaaaaactcttccactgcttgtatatataccacgttgcttttattcattcatccattgatggacacaggttgatttcatatctttgctattgtgaatagtgcaataaatatgagagtgtggttaactctttgatatactcatttattttcctttggatacatagctagtaataaatagcttgcacctctggtctcagctacttgggagactaaggcaagaggattacttgagcccccgaggtttagattgcagtgagccgtgatcacaccactgcgttccagcctgggtgacagagtgagaccctctccctcctcaaaaaatccttaagaaatatgttgatgcctggttcccttattcagaattttcatttgatgtgttgagagtgtagcacagaagttggaataaacctctcaaactgattttgatgtgcaaccaaggtcgggaaccaccaaggaagagtttttatgcataaagattcctatactctatcctagaactaatacatatgaatctctgggaatggagtataagactcggatttgaaaaggtgtccttagttattctaaggactgagcagtttggatactggtttgttagagtaaaatggttaggtacctagtatcaacctagccatctaaccttatattaacaactaggaaaataaagggttggagcctctgtgtttctttgctgaaaaatctgctgctattcttagttctatgaaaacaaattcaaaattcggttattatcaccttaaaagtacaaaacctatagatattgaaaatgcaattatttttctacaggcatagttaaaatgagtttgtatatattataaatcagtttctttataagtcatttatttagataaattttgttatactgacatgattcactaattttctaaatataaatggttcagctctcagttatttttaaactaaagagctgtgttatacttattatttctaattggcttttatgatgttttaggtttcttttgaatcccgtgtccttcaagtgctttccaactttgagaagaagaaattgaccacccggactatggaactgtgcgtaacagctttgaaagtgtatttaaaaattaaatctgtatgcctttaaatcagtgaattggaaatatattacatgtattttaatgactttcctcaaatacaataaattgttttctttccaatggaatggtgtttgtattttttctttacctggtttaacacatgtaggagaacataactagatgattacatcaaattctttttaaggcaattttataatatattttatttatgattacaaaaactgccttttaaaagttcttgcctggatatgaatgcagtttcacattttttaaattgtaatcttgctttttgtaattattttatatttgtctggcttcgagttttattgggttttagttttttggaagtgggggatttatcccaatttagaaatttgtatccttgccgtaatacagtctaccatttttgttctcccagatctttcatctgtcagaacatcactcaaaggtgaaaatatttcccacataaaattattcttttcctttagtgaaattagttccagctgtatatacgtaggaaaacattcttctttttattcgattcattcctataggtacgttcctgggtctgtgattacacctttaccttagaggcactgcccaaaaagactcaagtcttgtgtaaaaatgctgttgtggatcatagcttcctaccttttacagcatcgtgaggcagggagagtaagaacattagagacaggaattagaggcatggagaaatgaaccctggagcatcccaatggtgagatataaaatagttcaagaactattaaagaagactaaggaggaatagctagaagctaaatgaagaaagtatctcaaataggaaggagtgatcaaatattttagctgtgttgatgagttaggaaagatgagtttttggattaagcactgggtagagcaacctttgggacattgacgttgaccaacttggtggatatcaggagtaagaggaggtactcaagagaatgttggagaggaatttaatatagtgagtattgaagacaacacttaaggagtcttgctttcaaggggatgtgagaaatgggttgttaatggagggtaatatagcatcaaaaagctgtttattttaagatcgatgatatagcaggtttctatgctaatgggactgattcagtagacagaaaaagcataatgcaggaaacagagggatattgatgaagacatagacctggtaaaaaaatagaaggcttggttttaaagataggcacacaaacagctaattactaacagtaggatgtacgtcagattatggaggtccagatgtttgtagttcagtagataggaggagcatgtcaaatttttgtgatattttctcagtgaaataggaagcaagctcataaaaagggaagaaatcacgaaggattaaggaaggaaaaagagatgtaaaatgaatagctaggaatgtacaaaagtaaacaaactcttggcaatctgtggtttatttaagtggtattagtcaatgtggtttcgtgttcttttccagttcagttcagcagaggcgctatcactgaataagtacagaattcagtttaactaaaggtgagatttctctaggtgaataaaacagtcagtgatgagatgttcatacatttaggagaatgattataaaagagggatatggaaagtaatctgggttaaggagtgaagtgagaaaataaagaaggttgagacagtggaaaatggtatcatcaattgtagattgcagtgtggttgacgatgcaatggagttctcgaggtaggaactagaaatttgggagatttagataagagtgggttgattgaaattggaagtattagaggataatagtatataatagtactaagtatagtatactaagtatagtagcatagtgctaagtatatactatcttgtgagtataagttttaggatgtgaagatgggggtagcatagaggcaaagtgatggaaggagatgagttaaaggaattgagaacctaggagactgaaaggattatctaaatgaattttgaaatctcaacaagagctgtgctgagtgcttgtagtcattattttatgtttactactctgtgagaagacagcacttccttttgtgagtaatggaaagttctttcatgtgtcaattgtaagatactttattaggttcaattatctttagtaatgcatactaaaaaatagtgagctcagtgggattattcagtagatatgtgagctaaccccctctgtcagacacctaagaggtagaactgatggtcttcaagaggaatagagacttctcatcctaagtgtgtaagctgtgaaatatcccaccctatgttttctgaaaacaaacgttatatagagtgtccacataaaagctaacaggaaatctcacacacacacagacacacacacacacacacacacacacaaaacattgaaaaacttcaggaaagatataccctgtacccaacatgaacgaggtcaaagcaatgaagaaaaagctaggaaatcaaataagtctagaacaactgtgactaatatataaagatttgaggtggttatatccatttaaatggtatcaattagaaaggaaaaaaagaggccaggcacagtggctcatttctgtaacgccagtactttgggaggccaacacaggcaaatcaacctgtggtcaggggttagagacaagcctggccaacacggtgagaccccgtctctactaaaaatacaaaaatatttgctggacttggtgtcgcgtgcctgtgctcccagctgcttgggaggctgaggcaggagaattgttttgacccagaaggggagattgcagtgagctgagattgcgccattgcattccagcctgggtgatggagtaacatccaaaaaaaggtattttacataagaaattttattttatttttctgtaaattataaaatagcacttaatatggaatttatataccagaatctttgaatatccaaaatttaagatgagagcaattttgagaaacttttcaaagcttaggaaaaggtaactacataaaacaccattatgtgttatttatgggtacattagatgaagtaagtcacaaaaacacgcatagaaatgatcatataaacttgcaagaaattgaatgtcttgctattgaaggaaaggttgaggtgtaagagattgaggttgagtgtgagaagctctgtatatattgtatttttcttaaaaatatatatttaaactcacatttcttgtttttcaaatgttcactccaatgaaaattcttttacttttcctgttagaatttttatttccactctcacatatgcagtgtactattgttcagaaatattagtgatcctccttgcaaatgaatactcccatcctgctgattttcagaaggtccaagtgatttgctttggctgtgaaatgtaagcagaaagagtgttattttggggacttcccgattgcaaaacaacatagtatcgcaacttttgacatagcatttacgttgcattagtcattataagtaatctgagatgatgtaaaggttatatggaaatactacattttatataaaggactcgagtagttattgctttaagtatccatggtgggtcctggaaccaattcctcatggatatggaggcacaaggaaccactgtagttaaacaaataatcactttaaaacttaaaaccttttgcatggtgagtacagtcatgcaccgcatatatgatggtggtatagttaagtttattatgccatacatttattggaagtttcctatgtttaaatgtattgagatacacagctacactgctttacagttgcctatagtattcagtaaaataacatgctttacaggtttgtagcctaggaggaataggctatgcaatctaggttaatgaagtccattctgtgatatttgcacagtggcttaattacctaagggctttgtcttcagaacatactcctgtcattaaggaatgcatgagtgtagttggacaaaaaataataatgcaggcatacctttggcactgtcctaattcttaccaacatccatgattgcttaaatttgcactggaaagacttcaaaaaacagtgatatattaggacagtatatttccaatacatgacaaatgataacaacataagaactcaaaacattcaataagaaagaacataacaattaaagcaaaactagatgggaaaaggaagaagcaaatttcaagagaaaactcaaaaggccaaaaagtgtgaaatgatgttcagccttgctagtaattgggaaaaacacaaatctctttttttttttttttttttttttgagagggagtcaccctctgtcgccaacactggagtgcattggggcgatctgggctcactgcaagctctgcctcccaagttcacaccaccattctcctgcctcagcctccaaagtagctgggactacaggggcccgccaccatgcctggttaattttttgtgtttttcgtagagacagggtttcaccatgttagccaggatggtctccatctcctgacctcgtgatctgcctgcctcaacttcccaatgttctgggattacagctgtgagccaccgtgtctggcccaaatcatttttaatctattaggcaaaaattagagctatgataatattcatttttggtgggagtgtggcaaaaggtactataacagaatgctactagagagtaaactttgatacatttgtaagggcaattttgcataatatgaaaatttaaaaatatgcttccagtttcacatacgtttatctagcatacagaattacccatgtgtaaacatgtatacagatgttcattataacacttcttataaaaacaaaatatttgcaaatattcatatgaacaagtgcatacatatgatcttagtccagttagaattttctgttttatttcaatcctttaaaagactcaacttctgattctatataaacaattcaaaaaagaatgtgttttccctatgtgcatttggtcaggtaaattaaaaaatacacctcatgctagcctcacaaaactggaataagccttgggaaagaagttgtccttgaagcttgtatctgacattgtagcaggacgagccgcagaaaaaacctctcagacactgagttgtagaaggaagggctttattcagctgggagcattagccagctactgtctctaaatctgagctcctggagtgcacaatttctgtcctttttaagggctcacaacactaaagatttcacatgaaagctttgtgattgatttgagcaagcgaggtatacatgacaaggactacttgccccggtggtcagggagaaacagaatatggaagagagtttcacaatgttcttctacacaatatctggaatctgtgaatcacatcggcttctaaatcataagtggatgttcaactactgggtttaggccaaccaggcccaggtctgtttttgggcctggcgccgggctgcctgtctttggttttatttccttgttgtttttactgaatagaaaacaatgtaaaacaagaggagagggtctttctcctctctcattttctttctttgagactttcactcatttttattagtgggagctgtcacttttatgatttatgttcttctgtgcaatagattgatagccatttatattgtatgcttgtgctgaaggcttttggtgaaataagggagagacgaagttttttatgatttggagaaacacaggtatcagacaagggagcagtaagcaggttcctattactattattacctctattataagagttttaaatcctcctattgctgggaactactttctaaacatggctcctggattgagtctgtgccagccttgcacgagtacatgtgccagttttgttatatccttaagtatatgctcaactacttgttctttatcatctatgtgtaggcaacatgtttcgtcagattctctcgccaggcaagaacagtcaaggcttgttgggttttattagtaataatttctaaagcagcttgtaaccatatgagcatgtagataggggttggatatcctcatgagccatcttgtacttaagtggcgggtccatagtattgtatgattctttcaggggtgcattcatcatctttctaaccacttatggctatgcttcattttgcctgggaagcatagactgggaagcctacaagttcaactgtttttatgggcagtaagaagaaagatggcttcatggtgccaattacacagccacacgcccactggtcaggcagcttagcataagctttgtgtctacatatctagcataacctagtgggggccgtccagtcctggtggaattctggatgggcctaaacagtctgcaactttggaaatttgctgaatgcatttctttctgtgtaattggaactgtaccatgtaactgtttttgtggcaccattatacaggttttgcctaagacaaataagccgccttacgggatgagtaaatccttttctttctctagctacgcattactgtctaataattgtgacttttagaaactaaaaattgtcggggttgttcttttgggatggaattcgtgaggaactccatctgtaggaactaattcttgggcttcttatggccattgatctcctgttacagtccttccacaaacatcacatgaaatgacttgtagagactgggctacatgtttggctaattgcaaaaacaaatttttagtttttttcagaaatttcaggtataggcacattgaattcatcatagaaagtgtgaaatacttgtcctggtgagcgtttttgaacttcttcttttatcaggatgcttacactagaatctagtccttttctatcaatgcctaatgttatatattttcttttattccactttggatctgaggggtttgtgatgatcaattttaaagggttgcagctcccacttgtgcaagaggggctgacttttcttttttggagccaaacaggatcttttttatctttcttctaagtagcctaactgacgcaataccactattgacacatcgaacataaatatggttcttgacagatgtacttattttctgtgtgtaatttttcccaaatttagagaaatgcatcttatcctctgctgtttagtattaatagtggcacgagcatcaaattttaaagttacatttgtggggactcttctttcttctgttctagctatcactttacttgtgttacttagagaaggaccagttcttagtcttacttcgaagactgtgatcatgggggtttagaggggtcatagcacacatcgggctggtcacttcctggattacatacttagtactgggtgttattatacaaacaggttctgtttggagttcttaggcattcataatagctgtaaaataaaacgatcatcttaacttgtccttcttcagtgtcctgatgtatgcactgaaggcagtcctctgtgtgggaagaggtagtggaagcttttaccacacaggtccatgttataaggacaataagtcctacgacgattttcctcatgctttggccatgtgtagtctagtcagcttcgtggtgtgattggagcagggcttgtcattttcttcaaggtcacttttcagggattgtccaagtttggtttggcctcctaggtctcagcggctgcaggcttcatgaggctgtggtgaatctaggctgggattccttctacattgacagctgtgggagtggtcaggttaattgtctggggtcctttccactgtggccacagcggagccacgttccagtccttgatccacacaatgtcacctggagaaaaagggtgaactggggagaatcagctgcctgggcacctctcatttactcaagttgagatagtctgagtaattttccctaaggcctgtagctgccgctgtaatgcaatctcacctaactcttggggagtacctggaagccctcccagtatgggaggaggcctatgatacagaatttcaaagggggagtatgctgttctcttagaaggggtacacttaattttaaacaatactataggaaggacttgtgtctattttaaatttgtttcttgacatactttccagaaactttttctgatagttcgattcatttgctgcactttccggaactctaaggttggtaaacggcatgtaacttctatgaaattcttaatacctttgccgtcttctgtatcaagtcagcaacaaatgctggcctattatttgagccaattcgtagaggcagtccaaacctagggatgaaattttgaagaagtacacaggttacttcaggagctttttcagttcatgttggataagcctccacctacttagagtaagtaaacactagaaccagtaaatacttgttacttctacatttaggcatttctgtgaagtccacttgaagatcttcaaaatgagctgctccagaggcttctattccccgaggtacagaggggccttgcttcgcattgtgctgtccacaggtaaggcatcactgcgctactgttgtagcaacagctggcaagggtgagatgtagaaatactggcctaacagcttttcaagtgattcttggcctcaatgggtagtttcacatacagtcagcatgactgtatagcagcggtggcactgctattcttccatctggtaactttatgtatctttcctttattgtttgtcctctctctgtctgaaaaaattctttttcctctttagaataagttggcaccagatcaagcatttgaaggagtagcagggctgtgactgatgtctggtaaggagtagatgctgcttttcctgcctctgtgtctgctcagggctttccttggcaaaccgaagcggaaactcgctgatatcccctgcaatgcatgaatgccaccttttggggtttctacactgcttctaatcattgtagaatttcttgctgacattttatgtcttttcctctagaattttttccttatacaatgctccacatacttgaagggttagaaaggcatatcaagaatcagtatagatgtttacaatcttaggttcactgagttccagagcccgagttagaggaatgagttctgctttttgggctgaagtgctctgaggcaatggcttagcttcaacaacatcatctaagtttactactgcatatcctgcacacctttctctttgcgggttgatgaagctgcttctgtccatgtagaactcctaatctaccaatgcctatggctggtctcaaagatctggtctgctagaatagacatagtccaacacctctacacagttatgtttaacagggctgtctgatactgggagcaaagtggcaggatttaaagaattacagacttctatggttatacattgattttcacataacaagctttggtgtttagttaatgtagcatttgttagccaatggtgtcttttggtgttccttagagttacattagagtcagcttgggctgacataagtttttcttttaacttataagtcttgttgttgtagagacctctatttaaaaggctctcggtcaccccctttataactccattcaatgctttggctaacaccacaaagtttggaatctgcagtctgcaaaaatctcacagctcctaaatgttctcttatttgcctcctggttttaggttctggtaagctgcagatgacctgctttcttgctgaccatagactgcactccccttttcaaatagtgaatcctaggtagtgtacctgctgtctgcagatctgagctttctttttgggcactttatatccacagtcctccaggtgtcgaagcagggcacccgtcctttttgcacacctgactgccatggagtgtcctagcagaaggtcatctacatactggagcaggatgcaacctaggtctttagcaggaaacatttggaggtctccaaccgaggcctccccaaagatggtgggggactttttgaacctttgggaaagtcgagtctaagtgtactgaatggtgacatctgactccggatcttcctactgaaaggcaaacagcttttggctctcaggaactagcctgatgtgaagaaggcatctttcaagtcctgtacgggtcgatagtctttggtccttggtttagggacaggtaggaggtgggtgttccatggagactggcaaggaactagaattccagaggcttttaagcatataagatgagtctctattcctttaaaggcttccctgggaacaggatacggcttttgtccaattggctaggtcgtaggctaaacttctatgagtacgggggcttgattgattgccagcctcagaggattgtcctccatctctactcagagccgtcactcagctggagccacttttatttcctgagctggctcagttagcaaaagtctccactcttcttcctgggggactggaagggccatgatgactcctgtttctggcaactccagctgtaaagtgccttgttttgtcaaggaaatggtggctcttaacttgctaagcaagtctcttctcaacaaaggcaagggacagtcagacatatacagaaatggataaatcactttgtgtcctcccactgagcagttgcgcggtagacagaagtcctgcttggtagagactcctgttgctctaattctatcaatggtctttatagatgagggggccactggagtgcttactactgagtgttcggctcttgtatccactaaaaacttaatgtccttgccccttattgtcatcctgaccatgggctccttgggggcatttgagcctgttccccttaattctagcagcccctcagctagattgaacaaaatcctttcatcttggtttgaggtctttggctctgcatcactctgattttctttgagttggggacatttatctttctaatgtcctatttctttacagtaggcacattagtcatgctgcaaatgtgagtgattggacagggcattcctcccagaacccccttttttctgccttttcaggagaattcctctaattgtcacagccagcaaactagcgtttcacctggcctggcgttcgccctccttacggctttcttggccgcttgttgcatctctatttacaaatacttcattagctctttccagtaactgcaaggttttcattcctgcaaacctagcctgtttttgcaattttctctggatatcttctgcactctgaataactaaggccgtattaatcaacggctgattttcaggactctccagatcgaaaggagtgtacatgcaataggcctcacacggtctttgatagaactgggctgggctttcctcctttccttggatgacttcagaaactttatttacattggtacccttttgagccccttttttcaacctttcaattaatgcctctcggtaccctcttagcctttccatatctggtccttcatttggatcctattgagggtccgttcctggcagctgaattcttatgtattcttggggactttgataattggctgggatgtgctcctccagccatttaactgttgcctgcagcacctgttgccttttatgtgttttaaagaggtacatgagtagctggtggcaatcagcctaagtaggattctgagtctggataattctttgaagcaagtcaattagggcttgaggcttttcagtgtaagatggagtgttatttttccagttgagtagttcagcagaggtaaaagggtgatacacaaaagcatgcctttctaccgtatgtctgacctcatctgtcctagtatatcgctgctctctcagggcatttgaattcccgtcttgggccgttaagcgggctgccagggaagtggattttcccgcagtttcacttttgttcttgtctactctgggtggtctaggggctgtgggctcaggagaagggggcctccccactggataaggggttgagggcactgttggtgccatctcctgccttgagtcctcgagctctgggtcaaacagaactttaggtgctggcttctcttggccggtggagcgagaactttcctgaaataaatgtccctttgctactactactgctgctgcctgtccttttaccactgtagaggatctaaaactagctgtaactaggaatctctatatggaaattgatatgggtgcaggcacaccatgagcgatcaggccaagcttccgctcaggtggagtggggcaagttgaaaagacttgtcttactaagtttcagatgtctggactccaagtgccagttccttcctggtgttcagccactgtgttaatcctccgcggggatcactgctctggcgaggcgttcaaccggggccatttcctacctgggagcgctctttggatcccatccctcaggctggccagagtccctggcagcctgagggatgccccggccttactccacaaggcatgcctaatctgcctaaggagctgcctcggccgtccatcagttatcttgcttccaggtcagggaaccaagaaatgtagcaggacaagcggcagacaaaactctcagacaccgagttgtagaaggaagggtgttattcacctgggagcatcggatagctactgtctcaaaatccgagctccccaagtgcacaatttctgtcccttttaagggcacacaacactaaagatgtcacatgaaagggtcgtgattgatttgaacaagccagggatatgcgacaaggactacatgcacccgtggtcagggagaaacagaatatggaagggagtttcacaatgttcttctatacaatgtctggaatctatgaataacatcggcttctaaatcataagttgatttgtaactactgggtttaggccaaccaggcccaggcctggttttgtgcctttgattttgcttccttgttgtttttactgaatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaatagctaagtgtgtttcttttcttacatatacagtaatagttacatatcattaattttaaataaaagctctaattagtaaaaagaggtttaagacacttgatagtatgaaatacaattccaggttacacataagttatttattttggcaaaaggatgactcaaaaattttaaaactaggcaacaatctttactcattaagaggtaagacttagctttccaaacagtttgtctcctgtctactcttttctctccttggcattctaccaacaaggcaaaccaaatatttcattattcttctctattacatgaaaaatctgtacaagggaaggaaagccaaattttacccttacataggtttcaaaagaatcctttttccataggcaacatttacatttttatgcctttttataatcttttaccacaaacacatttaagtgttcctacacaccttgcatgtaaatttatttttagttgtcttatttacatatttttatggtcaatcttagcaatttttaactttaatgtaaacctggtaagttgttttaattatgtactagatgcagataaagtctgactttttccattctagttagggcatggttaatttcatatgtccccaggccttaccaagttgtaaagtaggcagcctacaaccttgaaatatttagcaagccttttatctaatttatgtgatttaaacctgctatttacatattgatgatatttgcattttccaatttgatctttaaaacagtttttatttcttagagtttaaaaacacataaactaaaaggcattacggttttaactttcctctaaaatatttgatttaagtgcttatttttatttaaggcaatcaattggtcctcgttacagacatcacacacaacacatatattgctacacagacaaacagaagaagatccagtagctctaagatttcttctcgtcccatttcctaattgcattactggcttcccagtagagccctttaagaacagggatagcaaaccacgaagtttctagggcctaatcaacttgtatagctgtaagacaaaaacagattttgagcaggattgatcagcctctagattctgggattccatgaggaaaacagaggtttctcccaaaatggaatccatcatgcattttctgtttttcccaaaacgtttcaggccaccagaagttatcttgtgtgcattaagagtggaaagacagagtggagaacagtaattcagtcaatggaaaagttcttttcaagaaaaacacgatccaagaagacaaaaacatgcaggtcttttaaatatacctataacttgaatatccacttttaatcaagctcagcaccctttcagaaaatcctttgacatcttctgtttcctgactttagctaaatcaagcaggtaatatttctggcttttgaattttaccaaaggtaacatcacaggggaaactaaaaactctccgttaggttataagttcaccgttagtatacaagatattttataagtggtggtaagcagcttttaccagatctagaacctttaaagtcagttgagagaaaggaagatttcagaaaggcagttagagtttttcatggcggagcacgagatgattaaacgtcacacagttgttaactggaaagtattcatcacccaggctgggattgaacctgggtcaccattgtaaaaaggcaacggctgaaaagtggtactaccacatggttacaggttatgcttaaggacataaaacaagtcggagacatgcagcaaagtttgttactgaccagtttatgagggtgtcttgaacagtgagctcaaggagtctcaggcctggattccattccaaggtaccctctgtctgactttttcttctattttctctccttttcctgagcctcctcctagtacgtcttatgaaagactgaggtggctactcttagaaggttttctaaggtgccttctagtcctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagagttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatattgattaaaaatcttaaatcaatatttgaaagttcttaaatatggatttgagtttcttaaagtagtcaaacttgttaacttctgtccctaagagatctaaattcctattttaaatgaaattcaattagctacatgtctacaagaaaaggcatatattactcttttattcagatcactctcgtaaaaaaattacctgagtagcatcattgtagttctcgatatctccacttccagttttacatttaccatcattgaaatcccatccagaatatgggactgctggaaagtccctacttccagggttgaagtaacttccacaggtactgcttgttcctgcactcacagcgttaccacacatatgattaattacagcatccacataaatacgaacctagaaaacaaagtttctacttcagtgtgacttacagagaggtagaaatttaaagcattattgatgcaagtttatagtatgttaataaaactccaaaatatttcatg

SEQ ID NO: 527 - DNA, 62725 bp, Homo sapiens
ctgtatatacgtaggaaaacattcttttttgtcaacttgacgttgacaaacttggtggatgtcaggagtaagggtattcaagagaattttgaagaagaatttaatatagtgagtatcgaagacaactcttaaagagtcttgcgttcaaggggttgtgagaaatgggttgttaatggagggcaatgtagtatcaaaaagctgtttaagattgatgatatagcaggtttgtatgctaatcagactgattcagtagagagaaaaaacataatgccggaaagagagggatattgctgaagccatagacctggtatacaaatagaagggttcgttttaaagataggcacacaaacagctcattagtaacggtaggatgaagggcagattatggagttctagatgtcggtagttcagtaaataggagcatgtcaaatttttgttatattttctcagagaaataggaaacaaggtcataaagagggaggaagtcatgaaggattaaggaaggaaaaggagatgtaaaatgggtatccaggaatgtaggaaagtaaacatactcttaggcaatctgtggtttatttaagtggtatcagtcaatgtggttttgtgtttttctccagttgagttcagcataggtgctatcactgaaaaagtacagaattcaatttaactaaagttgagatttccctaggtgaataagacagtgatgagatgttgttacatttaagagaaagataataaaagagagatatggaaagtaatctgggttaaggagtgaagtgagaaaataaagaaggttgagacagtggaaaatggtatcatcaattgtagattgcagtgtggttgaagatgcattggagttcttgaggtacaaactagaaatttgggagatttaaataagagtggggtggctgaaattgaaattagagtataataatatataatagtactaagtatagtatactaagtatagtataatagtactaagtatagtatactaagtatagtataatagtactaagtatatagtacttagtgattataagttttaggatgtgaggatgggagtagcatagaggcaaggtgatggaaggagatgaattcaagaaattgggaacctaggagattgaaagcattatctaaatgaattttgaaatctcaacaagaactgtgctgagtgctttttgtaattattttatctttactaccctgtgagaagacagcacttccttttgtgagtaatggaaagctctttaatgtgtcaactgtaagatactttattacatttaattatctttagtaattcatgctaacaaataatgacctcagtaggattattcagtagatatgtgagctaaccccctgtgtcagacacctaagagatacaactgatgattttcaagaagaatagagttctcatcccaagtacttaagctgcaaaatgtcccaccctatattttctgaaaacaaacggtatatagagcgtccatttaaaagctaataggaaatcttaaagcgtgcgcgcgcgcacacacacacacacacacacatacatacatacatacatacacacaaaacattgaataagcatcaggaaatatataccctgtacccaacatgcacaaggtctaagcaatgaagaaaaagccaggatatcaagtaagactggaacatctgtgactaatatataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatgattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaacaatagccaagtgtgtttcttttcttacatatacagtaatacttatatttcattaatttttagtaaaagctctaattagtaatcaacttgtaaaattcacaaaaaaaccaatagtattaaaatcccacttaattgttgaataagtgtaagataataatagtcagcaagttgttatgctttagaagactgactttaacctatttaagctatgaactcagaaaagcatctcaaccaatatgtttgttgccattagcatcatttaccgagctgtgtacctttaatttctgccattctataatccttccaaggagtgtttttatcagttagttagggatagctggtttaatgctgattcccatgcaaagttagcccggttgtatgctttttataatatgcaagtacttctggtgttaataaggttaaaaaatagaagaaacctaaattatacaatctacagttatcagttctattgagctcactggaatcttctcctactttatagacttccttctttttcatttttttcctaattgcttagacttgttgtatatgactttttgttctttttcttattctacaatctggatatttatttagggctttcatgacaccttgtagtctgggttttcttcccaattctctacctattcattcttcttcatcttgactttacatatggaattcattagggctctcatctaggtttccttataactctcagttgttttgtttatgcttaaatgagaacatagaggccataactcagaaactgtctattcttcacctataaattgtccctgccacaaagcagattcactgtgcattggtaccacttcggctcactgcatcttgggctgcagtttctactacttaagattgagtccagtgatttagaacatacacacaaaaagttgcatgaagcaggcttattgcttatagataggcatcaagtgacacagaagcccggcgttcaggaggagccagcctcccaagactcagaccgtttgcccagggtgttgaagactcatttgcacatgccctatttgtaccacagctgagggacccttgaaagaagcctgccccgtgttttataacccaggcatcccatgatacactgggctaaagcacttaaggaaatgttctaagaggcacagtaagagagtctgagacttatctcaggatgttgcattcccagctcattctacagctattcttgagatgcacaagttatagaggaggaaaacctgggttgctccaaggccacttggagagttgtcctgcatttcctctagcattttccttttttttctcctattacaataaagaaagtacatgtcattctaagaaaggccattttctctgcttaagttaatgataccattccatttttatcttttggaggactttagattatcctccctcttttgatttagcagtctttccctttcttctgcattagtcatcctagattacatgtattacagtcttccaattaaaaacatcaatgaccatcctcagatattcttctgggtatattactttgctcatttccttgctccctctcctaattaaacatctctttttatcacactgtctccacatcctcagcctccgtcattattcatctctctactgtccagttttcaccattatcacttcattcagtctgctcttgtcaacatcatgagtgacatttatgttaccagtccaatatatttctctgtcctcaccttaaaccacttcatagcagtattaatgatggtgggtcactttctctttctatcttccttttttcgtgttattctactctcctggttgccttctgtctcattgattgctctgtttcaggtttttgtttttttttttatcttattcttaggtggatcatcttattctgttccacctaagtcctaacttttatctatttctcttctttatcttctcttctctaggtgattggaatcatttccatggattttaaacaaatattttctgtggacacctaggtatcttcaattcagaacttggacttcagcctcatacttccatcagatgcttgttatcaccacttccatgttccacagacatctcataattaacatatttaaaatggaaccctcattttttttccttgcataaaccttttactacattattttcttactgcttagaaacccaggatattttctgatttatctctcttagctcaacaactttatctcttcatataaaccttagcatgaactattaattgtatcttcaaaatatctcttcatttattgcacttcttttgtatcttctatcacccctttatccagctcacaattatctgttctctgcattccaaaacaactctgcaactggtctcctatttccattattttactgtctccctttattttactaaagaccacaacattatattcatacaatttaaatccaattaaaatgttaatgcttaaaactcttaaatttttattgcattcagaataattctaaccactcatggtagcctacaaaatcacaccttatcagacatgaacctcagttctattcttttcccttgacaatcccatagccttaggtattctggtctttcgtcattttattaaatatgccatgtatttttattttatgttgtggactttttgtatgtgtttctccactcttttggaatcctcttaactgagttcttagcatggttggctcctgtttttataagtactcccaaacacaggaactagcattaccattttttcagtcctgcagttcagaaatctggggcttacgtttgaaaccctcttctcttacatttcccagaacaaataaagcactgaatactttagatttttgcattctatttcttcactatattattttctctttctacttctactatctagtaacccttttcttcaatgaccaaaatctattttacttccagcaatatggtgaaaagactatcgactcttaatttaaagccagactttattgtttataacaaatgcattgcagaatgtaaacagagaatgtaatcacaagccaggggctgggagcacttcatattagtttcttaacatgtcagaaccacattctttcatttttataagagagtaaccagagagccactttaagaatttttagtggttagcagaggagtagaggagagtgcccttgatacacaggtagtggtgaacatgtatctttacccccagcaggagagaaaagataaacattagagacataagctagcaagcttcaaaaaggatatttgaaaggggttttgtaatgggatatcagtttttgtacaagggaatttatttgtacaagaggttacggagcttttctcggagaataaaacaagcctgtctattacttgaaattttaacttttagaatagcttacgtgcacttatgctgattattgaggggttgactgcagcatcagcgtccacttcagtcctttctccaaccattccattatctaccatgcgatcagagtgatcttttcaaatcagataaccaccaccacttaccttaggataaaaagccaaaattcttatcagggcttgtaaccctgtgcttgaagtcttacctcactcaattctcctctttaatttctgatctctaaccatgctaatcttttagttactgcaactcaacaagatctttttagttctttaatttcaattcaagagacattctgctctttctgcttggaatgctcttttcttacctcttctcctaattaactcctgttcatcattcaaatcttaattcaaatgctgatcctgcatgaatatttattcagtattaggtcaagtcccctgatgactgttagcaatctctgtacttcttatcactcagcatagtactgtgggaaatatctgcattgttctttattgaatccttagtctcaggacattatccagaatgtcttacgaagagatcaataattatttgtaaaatgaattgagataataataaaagagaaaaataagagaaaaaatgtatctatttttgagaaggagaacatttttaatgaagatgtggccctggaatacagatgtttctctcatttttttcctatttcttcccaaatttaattaatttctggttaaccctgatttctcagatcataaaaatcatggggaaatcaactactttggcaataacccatcatgttttcaggatttgtaagccataacaacagtaaattctttggtgagctatactctcagtaagtaaatgaagaataattcaaatattattgggaaaatgatgccacattcatctgaatataataaatgtgaaattcattttactatgttcttagaactttgtaatactaatttataatagcagtttcatcctttagatatttcattttatctacggatctaattcttcctgtgaaattactgagctatttctctattcttagaagagaaaataactctttgtgataaaaatcattactatgtataattagacttccgtttacaagtcaaactgaaccaacgaacttacaatcatagaatgtgactagtcacagggaatggttggggcattagctcagtacctgtccaaagtgagctcattattatgattattagtatcaccattatcaatcagcttccacataaagtgtacctaaatgctagatctatatgatagcttccaaaatgacactgatttttaataatccaaatctttaaagagatcactttccattttagaaaaatgagatttttttttttttggaaaagatagaaaaacctctaagcattttaaccaagggttttagaacactttatttttatgaatatatcaaagcaaattccttctttattttgaaagtgactggaaacaatttcacggtcttactaagggctagtttaagtgagtctcaatttttcttctgttttgtttgctcttacaactttcctcacacacacacacacacaaagggagatataaaaaaatctagatataacagatgcaacttacaattttttggtaagaaatcataaagttttagaaaaaatcatttaggagtgtcaataaaaacgatatttaagaaaacagtaggaaaagtgatatattaaaagacttttaaacacctttcacaagaaattgaacagatgtgcaaatacacattatacgttatctatttgctcattttatcctgtccttaaacataaactttgaagataaaagaaagaagtgtggctcagggtcactcatgtaatctgtttttaggcagaaacaggtgtgttgaaaggtttttaggtaaaacaaccaccacttagacttcaataaagtagtatttattattttcctataattgcaaatttaccaaatgtaactcactattttttctttaatattttcaaagatatttttgagtaattattatattttcacaatcaattcagtagacatttttgaaaaacttatctgaacctagttttctcatctgtgaaatggaaacaatatatactctctcagtttgttgtgtcaaatgagaaaccatatatgatatactaaccactggttctggctaaatgcatacctcctcatcttttcagtaaagacatgactgttggccaggcacggtggctcacgcctgtcataccagcattttgggaggctgaggcgggcgaatcacttgatgtcaggagttcaagaccagccggaccaacatggcaataccccatctctgctaaaaatactaaaattagccgggagtggtggtgcatgctggtagtcccagtcccagctactcgggaggctgaggcaggagaatggcttgaatggcgctgggagattgcagtgagccaagatcatgccactgcactccagccttggcaacagagtaagactccatcccaaaaaaaaaaaaaaaaaaaaaaaagtaactgttattctcagtactttgggccagcacagtactgatactctcctaaaatctaactcaaagagaaaaatcacaaagcattggaattggagcagaaagtaatgtattcttgtttgacatctttccacattcagtctgtgtactgttagctgaaagctagttgacacaaaatgctgtcttaactttagtgttgtttctaatttagttctaggtcataaaatttgtaggaaagtctaattccaaaactttatcaacagctttgttacgctcaggtattatgatcagatatcttatgtgtgctctatgacctcaagcaaagattaaataaatctgtacattacagtgaagacccacatcaaccaatgcaacatacatttatttttcgcagcactcttttaggtgctttgaaacatgtaacccatgtttaagtgcagaggatagctggcaaggcaaaatataactatatgatgtgttaataagaatacagaggaatagttaaagtgatgcataataaagtacggaaatatgttgtttgatttcaaaggaaggggatagtacatatgctgaaatggcctgggaaagcttaatgataaggaaggtcttgagatgggtaagagagatttgtaaggaagagaaaggagggaaatttattccaaaagaagaaaaagtatgacaaaagcacaaaggaataaatgagatgaatggcagaaaatagatcagttaatcagtgaggctagagaagcacgtttatggaacactagtgaaaaatatgatgaaaaggtagaatgtgaccaataacagaaggatccattttctatcaagactttcttattagatttgatatgttcataccagcaatgtcatctctgaatataaaagatatctgtacttacgcaacataattatatgttatcactgggaaattctaggaagtaattatcagtccctttattaatattactatagaattaacttattcagttatagggtacactacgtttatagtttacttccttcctcccccagcctccagctttgtaatttaaatgaaactaaattccatcataattcactcactaacacataggactgccaacctctgaatggctttagatttgcgtgaacctgtatttgtcaatgcttgctccaggattctattggcatatgtcgaaataattgatttttatgacaacctgcttcctgcttactgttttttaccatagggagggaaaaaatagaattatcccttgatttagctgtcagtcaaatgacaactcaagcatgctataaaattaaagaaagccccacattctaccaggaactgatgattttagtgatactgctctctttgtagaagaaataaagtattttcatatcttatgatgaatatcactataatacattaaaatatagaattgcatccagcaaaatatcctgaagtggacaaaatatgcccctccaaaatatgccatttttgcacaataatttttttgagcagaaagcaattagctcactgactttcacctttctaaaagcaagacataaatttcaatttgtaaagacgtctccctttagtgtacttgtaagaaaactactccatagacaactcttaatagctgatgacttatctgcataagaaactttattaaacaatcctgatttagaatacatttcttcccccactttcccgtaacttacctcctgcaccgagcagccctaaacttcttttctttggctagtctaagatatacaccccaaatcctaattgcctctttgcatcacatttctttgtgaatttccatgtgtatgtacataattaattgttatttttcttgttaacttgtctgtgatcagtttaatttgtagggtcccagacactgaacctaggatggaagagaaaaagtgtttctgctttcctatggcttaggcaaccatgaatggacaggcagggcatcccacttgctccagaggctgcagctcaattgagatctgacaaagctgatgtgaaaactttactgaaccagatcctggaattttgcctacaaaaatacaaatacagaactctgttttttcttttccaaattcagatttgcacgagaataaaattataagaattagttctttggaatgtgattctggtgaattttctcctgagtatcattggttattgaccctttcactcccagggagagccattgctttcctgtgtgtctcattttgtgtcttgagcgcttggattcactttcttcctggtggcagggtccacattgttgggcttgctgtacaggcagtcagtcatcagattgtatgccctgagaatttgtagatggtcagatagagatgcaggttgcactgtcttgctactgatgttctaccaaccctctcagagggtttgtctaaatttttatttcttttggctattgctgggaggaactccatatcataaggacttcatttttgcactctctttgtggatacctcttacgttcttggctatctacattattaaatatgttttttccctctcttattaatcttttatttatttaaaagtggtgggttcccatggccttgggcatctctgcctctgtggcttcacagggtatagcctcatcctagctgctttccccggctggtgttgagtgtctgcagcttttccaggtgcagggacaagctgtcggggaatctaccattctgggatctggaggaaggtggccctcttctcacagctccactaggtggtgccccagcagggatcctgtgtgtgtgctctgaccccatatttcccttctttactgacctatgagagtttctccatgaaggccccgccactgcagcaaacttctgcctggacatctgggtgtttccatatgtcctgtgaaatctagggggaggttcccaaacctcaattcttgacttttgtgcacctccagctcaataatacatggaaaatgccaaggactggggctaccaccctctgaggcaatagcctgagctgttccatggccccttttagccatggctgaaggggctgggatgaggagcaccaagttactaggctgcacacagctcaggggtcctatgcccagccgaagaaatcactttttcctcccaggcctctgggcctgtgataggagagtcggctgtgaagacccctgacatgccctggagacattttccccattgcctttgagtttaacatttggctcctcgttacttattcagagttctgcagctggcttgaatttcttctcagaaaaagagatttgccttttcaatcatatcaggctgcacattttccaaactcttatgctctgtttcccattttaaaactgaatgctttaacaatattcaagttacctcttgaatgctttgctgcttagaaacttcttctgccagatacactaaatcatctccctcaagttcaacagttcacaaatctctagggtaggggcaaaatgccactagtctctttgctaaaacataagaagagtcacctttgctccagttcccaacaagttcctcatctttatctgagaccacctcagcctggattttatatcattattgacattttactcaaagccattaacaagtctctagggagttccaaaccttcccacactttcctgtattcttctgagacctccaaactgttccagtctctgtctgttacagagtcccaaagtcacttacacatttttgtgtatcgttttagcagcacttcactcctggtaccaatttaccgtattagtccattttcttgccgctgataaagacatacccaagactgggaaatttagaagagaaagagatttattggatttacagttccacgtgcctggggaggcctcacaattatggcagaaggtaaaaggcatgtctcacagggcagtagacaggagaacagagcttgtgcagagaacatccccttttttaaaccatcagatcttgtgagattattaactaccccgagaacagaacagcatgggaaaacctgccaccatggttcaattatctcccattgggtccctcccacaacatgttgaaattaaaattgggatttgggtggggacacagccaaaccacatcattggggatggaactttttattgtgagtatgtctgcacaagttacctgtgtagattttcttgtctgtgtggctgtgggaatgtcttagtcaaacacccctatgcaagtttacttatctatgactatagtttgattttttaggctgttcttttgtttgaatgaattcaactgagtacccaccctaactgcctgcctgactggtttgtttatttctcctctctcatttttacccacgggagtggagagcctaactgctgttagcgaggtggggtgatgctcgctacttcctgctggaaaggggcattgtatggggaacagcagctagggttccttctgtgagctttctaagggtccttggaagaaatttgtgtccatgcatggtttcatttgcatcaacatttgtagtttgatagactttaggcaagaaaaaaaaatggattattagaggacatgtataaaaatgaaacaaggggataggtaatgaaagctcaaaaatctcaaggcttcagccatgcccagataaatagtggctatagttatgcctactaagatttgggtgcatggggctttgctttggtgaacttccttggttttattttcccaaacaaagaaacctctgggttatgggtaccctgtatactcccataacctggtaggatttgcaggataatagcccaaaactagaatattgattcagatttttacactacttattccttttttattttgagttgcagccagagattgctggtttgtttacaggaataagcagagttattctaaaatgtacgtgatatggtttggctttgtccccacccaagtctcttctcgaattgtagctcccataattcccatgtgttgtgggagggatctgtgcgagataattgaatcatgatgggtgtttttccccatactgttctcatggtagtgaataagtctcaggagatctgatggtattataggaggaaatccctttcatttggttttcatcctctttcttgtctacttccaagtttttgccttccatcatgattgtgaggcctccctaaccatgtgaaattgtgagtccattaaacatcctttttaaaataaattacccagtgtcagatgtgtctttgctagaagcatgagaacagactaatagagtaggcaaaacttaaaaacaactaatgagattagaatttaatgacaagtgtatgataagttttgaatcaaattttgctctctccagtcctcatttttgttcaaaacaaatcatgatagtcattttgttaaaaacaaattacgactgagttgtttgcaatgtaaacttaggctcatacttggcttgattatttgcataatgtgcagcaaaaataattatttttgcagtcttttaaaataagctttgatggaactctgttccacaagagatctcagataggacttttttaaagccaagcccggccatgagtttgtaccctcaaatacctatgagttgagtgaattcctctcttcttaatgtcacaagaatatgtggttcctgggactgttatatagtgacattctttactcatcacagattagaaaccccgtacacagattatgtagacaaggtaggaggccacatttcccaatgggcttttattggctctgtaagtgaagcttgattcctcaaagagaagcatatccatccaatcaaagccttggtaaaacaaccagtttctccaattgtgtcatgttgcaaaagaaaatgaattcttactgcactggtgcaaacaacgatattgccataagtttagaatattcccaaatagtttccaaattctggagtaacttggcagagagaaacaaatacgctccaaattttgttcactggtgtataccttacttaattcttaaaagctgtagatagcttaaaagaaaggtttccttaactctgaagaacaaaacaaagaacagcaatgttttaagcaaaaagtaaaaaaagattatttcagacttctattagtttagttcatgcagttaactcctgtctgatattcataaacagttaagatcttcatgactcttgtatgatttcttttattctcatgtcatgatttccaaagttatcagaaacctgcatttgagagcacattgtaaagtcctacagctgattgtaaaacatcttttgaagaggattaaaacaagacaacatttatctgtagatgacatagtgttcaggttagttacagtgaaaaacatgactggcaaagatatttggttatttctgtggtttgcaataacttaatacaataatcctaattatgatccatagcatattctcaagcattagaatttttaaaatcccatacaattttggaacatatattaatattatcactaaaatataacctgaataaggttaaacataattttgtcaatcccacttacatgaacctgtcaaaaaattctgtttacttctcttctggatgcttcagggccctctgtagcatacaaaaggtagggttcaggagagacaattttgaatgtgaagtttgattttgggaagcctgtcaaatgttacaggtttaaaacacttgatagtgtgaaatacaattccaggtaacacataagttatttattttggcaaaaggatgactcagaaattttaaaactaggcaacatcctttactccttaagagggaggacttcgctttccaaacagtttgtctcctgtctactcttttctctctttggcagtctcccaacaaggcaaacaaaatatttcattattcttctctattacatgaaaaatctgtacaagggaaagaaagccaaattttacccttacattggtttcaaaataatcctttttcattggcaaggtttatattttatgcctttttataatcttttatgacaaacacattttactgttcttacacaccttgcaggtaaatttatttttagttgtcttatttacatgttttaatggtaaatcttaccaattttaacgttaatataaaacctggtaagttgttttaattatgtactagatgcagataaagtctgatttttccatcatatttaggggcatggttaatttcatatgtccccaggccttaccaagttgtaaggtaggtagcatacaaccttgaaacatttagcaaacctggtatctaacttacatgatttaaactttctatttacattttgatgacatttgcattgtaccaatttcatctttaaaacaattactatttcttagaggttaaagtcccataaactaaaaggcattagagttttaactttcctctaaaatatttgatttaagtgcttatttttatttaaggcaatcaattagagctcattagagacatcacacacaacacatatatcactacacaggcaaacagaagaagatccagtagttctaagatttttttcttgtcccatttcctaattgaattattagctttccagtggagccctttaagagcaaggatagaaaaccatgaagtttctagggcctaatcaacttgtatagctgtaagacaaaagcagattttgagtggaatctatctatgagcctctaaattctggtattccatgaggaaaacagaggtttctcccaaaatggaacccatcatgccttttctgtttttcccaagaagtatcaggccagcaaaagttatcttgggttcattaagagtggaaagacagagtggagaaaacttattcagtcaaaacaaaagttatcttgggttcattaagagtggaaagacagagtggagaaaacttattcagtcaacacaaaagttcttttcaagaaaaacacaatccaagaagagaaaaacataaaggccttttaaatatacctataacatgaatatccacttttaatcaagctgagcattctttaagaaaatcatttgaaatatgctgttacctgactttagctaaatcaagcaggtaatatttctggcttttgactttaccaaaagtaatatcaaaggtgaaacaacaactctcaattaggttataagttaaccacgagtatacaagatatcttataagtggtggtaagcagcttttaccagatctagaacctttaaagtcaattcagagaaaagaagatttcagaaaggaagttagagttgttcatggaggaggaagagaagattaaaagtcacacagctattaacttgtaagtattcattacccaaaccaggagcgaacccgggccaccattataaaaaggcaatggctaaaaagaagtactgccacattgttacaggttatggtcaaggacataaaacaagatggagacttgcagcaaagtttgttactaaccagtttacaggggtgacttgaacagtgagcttacggagtcccaggcctggattccgttccaaggtaccctctctctgattgtttcttgtattttctctcctttttctgagactcctcctagtacctgttatgaaagactggggtggctactcttagaaggttttttaaggtgccatctggttctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagggttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatttcttccaggcagaagctagaaagagaggtttgaggtttaacagactgtcactatatatgcctcccagctgtagaaaattaacttgtctcattaataaactgttcaaattcatttagcagtggtgagcttttacatgaaggaaaagcaactaaaatggagagggatgagggtattcactcgggatgaaatatcttttcatagagtaccatgaatgactgttattgtgggacaaaaagcacttactgggtgaaggtttagactgaaatcttgaaatcccctggtattttgagtttctgcttagcctttccaaaggaataaaatcagatatgtatctatctcagtgagcagaggagtgactttgagtagaatgggaggaaggtttgtcctaggcagtttcccgcttgaattttccctagtgatttcaggggcccagtatattgtcctttcacacatctgacaagtaattgataaccagaatatctaagcagctcaaacaattctagaggaaacatatctaatagttggatcaaaaagtgggcaaaagatttaaatagacatttctcaaaagcagacagacatatggcaaacaagcaaatgaaaatgtgctcaacatcatcgatcagagaaatacaaataataactacaatgagatattatctcaccccagttaaaatggcttttatataaagacaggcaataaggattgctggtgaggatgtggagtaaagtgaaccatcatacactttttatggttatgtaaattagtacagctgctatggaaaacagtttggaggttcatcaaaaaactaaaaatagagctatgatgtgatccagcaatctcacagctaggtatatacccaaaagtaagaaaatcagtatattgaaatgatatctgcactcccatgtttattccagccctgttcacaatagctaagacttggaaacaacctaaatatccatcaacagatgaatggataaagaaaatgtggtacatacatacaatggagtactattcagctataaaaaaaaatgagatcctgtcatttgcaacaacatagatggaactgtacattattatgtgaagtaaaataagccaggcccagaaagacaaacatcacatgttctcatttatttgtgggagctagaaatacaaacagtggaactcatggtcataaagagtagaaagatggttactagaggctgagaagggtggatgggaagcaagtgggaatgttcaatgggtatagaaaacagaagaatgaaaaagacctagtatttgacagcacaacagggtgactatagtcaataacaacttaattgtgcattttaaaataaataaaagaatataattggattgtaacataaaggataaatgcttgtggtgatggataacccatttaccctaatgttattattacacattgtctgcctgtatcaaaatatgacacatgccctgtaagtttatacacctgcaatgtaccaacaacaattaaaaatttaaaaaggtgtatccttcccagtgaaccaaaatattttacattgataacttttaagttatcatagtgtgttggaataatcacagctttggaaagaaaaaaattatagatataaactttcaaagatggcaggagatatagatctctctttagtggattaaaatatgccatttgttattaacatcacactgagattttttaacacaggacatcttctggaaatgatatgattataggagttataggaaaaagcgttttttcatactgtgattacctatgctatgaagaaaggagatatttcctctatgatgtctaatttagcataattattgtttttaaactatatttagatttaattaagagatacacaaacaaattacttttagtagtaagaagatttttaaaaattttttgtgtaagatgactatgtagtaaagaaggttacaaacttactttttaacgtagaaaaataatctcaccttcttgccccatggaaaattgaaatgttatgtggaacccagtgtagaaaaactctcagtgaggttttctgtcttaagtttcagtggattgaggtgagatcaacgcctgttccacctttttcctccctgtcctagcaggcttgaaaacatttatacagccataaaatgttgcctttaaattcaagtatagaaaataaaatttaaaatgtgatatttttatatattttattttaatatcttacatgggaaatgtttttgaaatgttaaaaaattaaaatttttaaaagagtactgtgaaataatctaatcacatgtggaaattttgttactatttccccaagcatttttggtacatttaatgagttgaatgtaactcataagtagataaaaatgtttaatatttaattttctgctgcaataatgttacaaaacaaccttaaattctcagtaacgttaaacaacatatttttttctcccaaatttccaggttatttaagggcagttctgcttcatattgcagtttgcctgggctttactccaggctgtgtgttggagttaggtctaatatattgtatccctacgtatcccagttagaaagcctaacagatttctttgtacttcagtcagctcgattgtatttgtcattcaaaagccaaagcatttatcctaacaccaattgcttcttttttttttttagatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtaagccactgcacccagcctaactgactgcttcttttgttctgtagtctttctccaaaactgtttttctctgtactcactttcaccttctctcacacatatatgtccctcatgtccctttatgtctccagggtcttctatttccacgtaatcttaattgttcatcatatcctggactcatgagtaattaatctgttattctccctgaaagtgcagccttgttgaatagaatgtgttctttaaagagcagctttgtttctcgagtgaggtattaacttccagatttaagtgaaaatgagttccaagttttatgtttcattgtgtgtctaagactgacaccgtttattactgtggcacttacagcttgctttcaatgcctccaaattctctatctgaagggctgggtaccatatctcatgtctgaacatattcctcagaatcatgcagtaccagctatgttccttctttatattatggctcctgaggtgcctgttaagcagccaggtgaaattgccttttaatcagtataggaacagtctctttcctgctgatgctaatgctttttgtaaaaaggtcatgctgtattgaagttcttctttcacggcaaaaccactaatggaactcatctacttactgatgggtggaagctctttgtatgccaaagtcttgttttgtttgtgaagaatctctttccctcaacagtgatgtgctacgttaggtctcaaatcattgttgctttttaatccaaatttatgacaaagattttcagtttgtatgcataatttccttctctggccttaaccatcagtctgtggacttgccaagcaacaaccacaagaacaacaagtctgaggtcaagagacactatttagatctcagaatcatttgttgtcctttatcctttgacaaagttttgcctttctttctttatgagattttttccctaatggtttctcaatctcttgagaagaagaaagttcttgactcttgcagtctttctcattagttgaattataccatcagtacagcttctgatcatgtcgagaaatccaccatgaagaaataaaacatttccgattacatggattacgtttcttggattcttataggcattaaacttcattctaggatacaacctcatgatcttgtcttattctcagaacaagaaatatattactatatacattacaatatatatatattgcagtttccttgctatatatatatatatatgtatgtattatagtaaaccctgtaggcaagcaggaacacttcagaagtctcaatgaatccatcattagctgttagtaatgacaacactgttagaattatttcaataatcacacattgttatggtctgaatgtgcacccccaaatgtaatatgttgaaattttaacacctgagggcatagtattaggaacttgggagtggaactctttttagtgctattatgaataagatgcttgccttttccagcaaatgaggacacagccacaagctgccctctaggaactatgaagttagtcttcaccagacacaaaatctgcttgattttgaatttagcctcccgaactgtggaaaataaatttctgcttttataagccactcaatttatggtatttggttattgtatcccaaacagactaaaacacacattatttacctcctttttggactgtctggggttgttgctttaaacttgcttcagtgcctagaactgctccaagctccctgtcctctggcacacacgtataaataattctgctggaaaccgacatgtttcactcagtcatccaaatgtatttataatgttgtccaaatatatagcacttgttacaatgtttacattttagacatattttgagatatgtgccttaacagagtgctgtgattattattaatatttagtaacttatcttaccagacctaaactcaaagtttttcacaatggcaatgccttatttgggacttatttgggactgaatgtatgaagatcttacattgagtccaaattgatttctctgttagtctcgcaataacattaaagccacagaattatctgctgtatatttcttgtcttgttgtagctgatattctacatattaggacaattaggacattagtaatatctattaaccttagaataaaatgtcatattgaaattgaagaggaatattggaactttgctaagaaagaatgcttttcacacacaatgatatctaaaatggagcctctgttcctggaggtatattttacaaaaattcagtgttactataggaattctgtacacttctttcttagacatttgtattccatcagtgtcagtcctctctgtattttaaactaaataggatttctttttccatctttctgtttgacaagtattgttttgctgaaaatttgctattcatgttcttttaactcattagaaagaatatttagggtctttagtgacaaatgacatggtataaatgaaaagaaaacactgacattgtaattgagaaatactaattaattaggagaatattatttaaaaacattgtttaaatatttctttgttttattattattatactttaagttttaggttacatgtgcacaatgtgcaggttagtacatatgtatacatgtgccatgctggtgtgctgcacccattaactcatcatttagcattaggtatatctcctaatgctaaaccctcccccctcccccaaccccacaacagtccccagagtgtgatgttccccttcctgtgtccatgtgttctcattgttcaattcccatctatgagtgagaatatgtggtgtttggttttttgtccttgtgatagtttactgagaatgatgatttccagtttcatccatgtccctacaaaggacatgaactcatccttttatatggctgcatagtattccatggtgtatatgtgccacattttcttaatccagtctaccattgatggacatttgggttggttccaagtctttgctattgtgaatagtgccgcaataaacatacgtgtgcatgtgtctttatagcagcatgatttatagtcctttgagtacatagccagtaatgggatggctgggtcaaatggtatttctagttctagatccctgatgaattgccacactgacttccacaatggttgaactagtttacagtcccaccaacagtgtaaaagtgttcctatttctccacatcctctccagcctacaatgaactcaaacaaatttacaagaaataaacaaacaaccccatcaaaaagtgggcaaaggatatgaacagacacttctcaaaagaagacatttatgcagccaaaagacacatgaaaaaatgctcatcatcactggccatcagagaaatgcaaaacattgtttaaatatttctatcacaaattgacagcagtacaatgcacaccaccagcaatgtataattctagatatgagaggtaaaaagataaaacaggtattgcattttctccagaaaacttatcatttagtggaaactggccaataatttcttaggccttaggataattttacctttgattctctagttaatccaaaatatataaaaatattaaccaaaagtatatatttttaaaatgcctacataatctaatgcagtattttttgctctcttcttgaagtgaattaaattccttatcactgaccataaaattgaactccattgatgattcttatttaaaatagttaaaagtgaatgtaaagatcagttgtggttttccttttcttacccttgtttttacacttatatttgcctgtgtcattcacacacttttagaattcaaaacaataactagaaatgtaatcatttgcttttcaaaagcttttcgcatctttccaaagttaatataaagtcttacaaaacttttagctaattcacaaaaaaatcaaacatatatagttgaagcaattttttttttttggtagatttcttcaaaccacagaaatttcagttatggcatggtaggtcttttgaaatgtttcattttttgtatttgaagatgcagagcaaaagtatttccactccaactcccctttaataaaaattgaatgtaacaaaaaaatcaaaatctataggaaaataaccccttcatctatgttaaaactatgagatttccagcccaaataagttataagaaccagtatagagtccaggctcggtggctcacgtctgtaatcccggcactttcggaggctgaggccggaggatcatgagttcaggagatccagaccatcctggctaacatggtgaaaccctgtctctactaaaaatacaaaacaaattagccaggcatggtggtgggtgcctgtagtcccagctactcaggaggctgaggcaggagaatggcccatacctgggaggcggagtttgcagtgagtggagattgcaccactgcactccagcctgggagatagagtgacactccatctcacaaaaaaaaaaaaaaaaaaaaaaaaaaaaaaggaccagtatagaaatactaatacagtaaaaggtggacttatatataaagaaaataaccaacagattttgtctatggcacaaacttcttagaaattttgaggtctttagccttaaagacctaatcaaatatttattactttgaacagtgagctactgggatatgctgggctttgagcctatgtacaaatctaattttagaagtcaggacgtgttgtaagcaatagcaaagaatatgctagatgatcagcttggcaattgttgaacaaacttcattcagcagtgtgaggacgtaattaaagcagttgaccttcaatctattcactctctttattggcaaatggccgaggaataagactagaaggaagatgaactggtttagtctctttgtcagctgaacttgtggtgaaagagactactgatattttctaggatgaagagatcttatctctgaaataccctttgcaggttgctcctgactgaaacaaattcacagattctttcttctcgctcaattttgctgttgattcttcattttacattctttatttcatttattttatgctttagctctagaattttagtttgggttctattttttcaatctgtctgtggaacttctcaattggtttgtgttttgttttttttcaagttttggttgaattgcctatttattctcttgtaactaattactctcctttaaaacaattatttgacatgaaaaaccttgcaaaaatacaaaaatctataaacttcttgacaaagaattcaaaataattattttaaagaatttctgaatttgcagcaaaagtttgctatagagcaacatgaaagcacagaaaagtatgaaactcattgattaaggtaaatatataaaaaatacagaacactctaatagtgtagtagtggtgtgtaaatcagttttattgctagtatgaagcttaaaatccaaaataataataattatagctacaataatttgttaatagatatagaatattaaaaatatataatgtgacaccaaatatataaaatatagtgggctgagtaaaagtatagagttttgaatatgatcaaacctcagtttaaaatagtttgctccaactacaagatagtatgtataagcttcatgctattcggaaagcaaaaacctatagtagatacccaaaagacaaagagaaatcaaagcatgtcactacagaaaatcataaaatctcaaagaacgacagcaagggagaaataaaggaacaaaaatatgttaaaaggctgaaaagcaatgaacaaaatgtcaattgtatgttcttatctatcaataattaccttgaagataaattcattctattctacattcaaaagccagagtggctgaatggattacaaaaggagacccaacaatatactgcctacaagagactcacttcagcttcaaggacacatatggtgtgaatttaggggatgagaaaatttgatattccatgcaaattaaaacaaaaaaacaacatggataactatccttatatcaggcaaaatataccttaagataaaactctaacaggtgataaagatggtcactatataatgataaagggatgagttgattaaagggatgaaacaattataaataaatatgcacttaacattagagcacttgaaaatgtaaagcaaacattaatatctggagggagagatacagagcaatcaataatactacagatataggtaaccttattgacactgttgaaattatcaatactccaattacaacaatggatagatcatttagacagacaatctgtaaggaaaaaaaaattagacttgatctgcactttagaccaaacggacctaacagatgtatgttcacatttcatccacagccggagaacaggtgttcttttcaagctaacaagaaacatcctctaaaatagagcatacttgaagtcacaaaatgtcttaatacatttaagaagattgaaattttatcaagtatctcttttgaccacaatggtatacaactagaaatcaattaacaggaggaaaactggaaaattcaaaaagaagtgaacataacacaattcttaaaaactggtggtttaaaaaggaaataaaaaggaaaataaagaaatcttgatacaaaaatgaaaacacaatacaccaaagcttgtgggatgcagtaagacagtgctaagatgaaaatttgaaatgacaaacacctacattaaaaaaaacacaaatatttcaaataaacaatctatcattaaacctcaaggaactagaaaaaaagaagagcaaactaagcccaaagttaatagaagaaagaaaataagaaagatcaaagcaaaatagagaaatagagagtagaaaagtaatagaaattgaaagacattctgtgttcatcaatgtgagaaattaatattgtcaaaatgctattacacaaagcaatctacagattcaatgtaatccctatcaaaagtccaatggcatttttccagaaacagaaataaatcctaaaatttgtatgaaattacaaaagactataattacccaaactgatcttgagcaagacgaacaaagtaggaggtaccacacttctcactttcaagttatattactaaactacagtaatatatatatatatatatgatactggtatgaaaacagtcacatagaagaatggagcagaatagaaagcctacaccaatatcgtcaaagaatcttcaataacatgcccaaaacacctaatggagacaggatagtctcttcaataaatagcgttggaattattggaggcccacatgcaaaagaatgaaattggagtgttatgctatgcacaggaataaattgaaaattgaaaaggaatttaaacataacatctgaaaccaaagaatccctagaagaaaacaggggaaatcctccataacattgaccttggcatgatattttggctatgaatcccaatgtatagacaagataaacaaaaataaacacatacaactacatcaaactaaaagattgtggcacagtaaataaataaataaataaataaataaataaaaagtcacccatggaatggtagaatgtacttgaaaacaatatatctgataatgcattaatatctaaaacatataagaaactcataatcagaaaaaaagtaacctgattaaaacatgagcaagagacctgaatagacattttttcaaaggaagatttacacacggccaacacatgaatgaagaggtgcacaaaatcactaaacatgagggaaatataaactggaatcaaaatgagatgtcacattacatctttcaaaatagctaatatcaaaaaggcaaaagataaatagtgttgacaagaatgtgtcgaaaagagaacccttatagagttttggtgggaatgtaaattggtacaaccattatggaatacagcatggacactcctcaaataattaaagatgtaccgtatgttacagaaattatacttttaggcataaaagtatatacctgtgggtgtgttggctcacacctgtaatcccagcactttgagaggtgagggaggcagattacctgaggtcaggagttcacgaccagagtcgccaacatggcaaaaccgcatctctactaaaaaacacagaaattagcccagcgtggtggttggcacctgtaatcccagctacttgggaggctgtggcagggagaattgcttgaacttgggagacagaggttgccatgagtcaagattgcatcactgcactccagcatgggcatcagagtgagactccatctcaaaaaaagggtatataccttttatatacttttccttttatatacgatagaaataaaatcactatcttgaagagatatctgcattcctgtgttcattgcagctttattcacaaaaaccaaaatatggaaacaatctaagtgttgacagatgagtaggtatgtaaattatgatatctatcatctatctgtctatttatctatctatctatctacaacggaatattattccgtatttaaaagaatgaaattctgccatttccaacaaaatgaacgagcctagaggatattatgccaagtgaaataagccaggcagagaatgaaaaatactacaggtacaacaatgaaaacttgccattataagatgaataagttatggaggtctaatgcacaacagggtaaaaatagttagtaataatgtatgctttaagttcactgagtgtagatcttaactattaccctttcccaacacatgataactatgtgaagacatgaatatgttaattagcttgattgtgaaagtccttttaaaatatacttgatgggcgcagggtgagaggagagtgagggtcaaaacactacctgctggggactatgctcactagctgggtgatgaaatcatttgtacaccaaaccccagcaacatgcaattacccacgtaacaaacctgcccatgtacctcctgaacctaaaatagaagttgagaaaagaaaaaaaaagatatcaatttcctataaggagctccaggtttgttccaaacagtagcgagacaaacagatcaaggatgaaatatataaaatagtaggcaaaacgtaaacaacatgtgtaaggcaatcgattctatataactcagcaactcctagggttcttatcaaataaaatcactgatgtgtcataacttctaaactaaaaacaacacaaatgcccattcacagtagaatgaataaataaattacttttgcttcccgcgatgaataccacacagcaattaaacaatgaactgctgctacacaaaacatagatgattctcacaaatttcaactgagtgaaacaagtcagactcaaaagattacatacagcaagtttccatttatatgaaattgaggagtagggaaatccatcgtgatagatttcatgataatgatgaccattggtgagtaactggttgagaaagtgcgagagccaggggtgtgggagctggaaatcgtccatatcttgcttgatttgggtggtggtgatagggatatatacacttataaaaattataatgctatatgcttaagatttatgtattttactatttgtaagatatatattagttgaaaaaatgcttcagtgtaaaggaaaccagtaaaaatacgctacctacaattgtagcttttgtttatcaaaaaagcatttgagtagtctattgattggtaattagcaagtttatgttaagcagccttgtcctgaatactttttagtatgtaccattaagcatttgcctttctcaactagggctaattaaaaaaaactcaaaacctcacattgtacacgttgaatatatataattttaatttgtgaattataccaccataaaactaaaaatctaattaagttgagtttgaatacattttagggaaaatacgataaagaaaattaggagcttaagaatatgcatagataaaaaataaacttgatagaaatattatttatatattatatattatgtatatttatatatatttatatataatatataaataataatatatatataaataatactatatgtatttcagaaaatcatataaaaagctgtgctaaaattttccagagagagagtaaatagttctcctgtagtggattaaaatgagattagcattggagtactagcgtaatacaacagatagagtctgaagtcagatctcaaaaatacaatatatttgctaagtaatgcgagacaagctatttaaagtttttggacctaaatatccagtctgtaagtttgttggaaaaaataaatacgctaatagagaacttaacttacagggagtgctaaattattacctgttactggaaaacataatatcagtgacattaaaagcttgagtgttgtagaacaatattttgaaatatcattttttgaagttatatacatatttatattactttaataatttgcacaacataggaaggaaagcttgctttgcacaggcaacatttttgccaaataatctttaaatcatcatgaattctcaattagattaacaataataaaattttattgtagaagactattttttcattaatatagttgtacatgcacatagggtaaatgtaatattttgttacttgcctaagctttataatgatcaaatcaaagtaaccagggtgtccataatctcaagtattatttccatatgttaagaacatttcaagtcctttagctattttggaatatacaatacattgctgtttatatgtagtcaccttactctgctatgaaatattagaacatatgtcttccaagtaattgtatgtttggacctattaacaaacttttctttattcctcccacccagagaaactttccagcctctggtatctatctataattctattctctacctccatgagatcaatatttttagttttcatgtaagaataaggatatgtgatacttgtttttctgtgcctggcttatttcacccaacacaatgacttccagttccatccatcttgctgtaaatgataaaatctcattcttttttatggacaaaaagtattctactgtgtatatatataccatgttgtttttattcattcatccattgatggacagaggttgatttcatatctttgctattgtgaatattgcaataaatatgagagtgtggttatctctttgatatactcatttatttacctttggacaaatagctagtaataaatagcttgcacctctggtctcagctacttgggagactaaagcaaggggatcacttgagcccccgaggttgaggttgcagtgagccatgatcactccactgcattctagcttggttgacagagtgagaacctctccctcctaaaaaaatccttaagaaatgtgttgatgcctggttcccttggtcagaattttcatttgatgtgttgagagtgtagcacagatgttggaatgaacctctcaagctgattttaatgtgcaaccaagtttgagaaccaccaaggaagagtttttatgaattaagattcctatactctatcctagaactaatacaactgaatctctgggaatggagtatcagaatcagatttgaaaaggtttccttagtaattctaaggactgagcagtttggatactcgtttgttagagtaaaatggttaggtacctagtatcaacataggcacccaacctgatattaataactaggaaaataaagggttggcgcctctgtgtttctttgttgaaaaatctgatactattcttagttctatgaaaacaattgaaaatttggttattatcaccttaaaagtacaaaacctatagatattgaaaatgtaattatttttctataggcatagttgaaatgattttgtaaatgttataaatcagtttctttataagcagttcatttacataaattttgttaaactgacatgattcactaattttctaaatataaatggttcagctctcagttatttttaaactaatgacctgtgttatacttactatttttaatgggcttttatgatgtttttaggtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatggaatagtgtttgcattttttgtttacctggtttaagatgtgcagcagaacataactagatgattacataatttctttttaaggcaattttataatatattttatttatgattataaaaactgcctttaaaaattcttacatggatatcaatgcagtttcactttttttattgtaatcttttttataattattttatacttgtctggcattgagttttattgggcttttggttttttggaagtagggtatttatcccaatttagaaaatttgtatccttgccataatacagtcttccatttttgtacccccaaatctttcatctgtcagaacatcactcaaaggtgaaaatatttcccacataaaattattctgttcctttaatgaaatgagtttcagctgtatataagtaggaaaacttccttttgttctatttgattcctttttacggatactttcttgaggctgtgattacacctttaccttagaggcactgcccaaaaagactcagctcttctgtaaaaatgctgttatgaatcatagcttcttaacttttacaacatagtgaggtagggaaagtaagaacactagagataggaattagaagcatggagaagtgaaccctggagcttcccaatggtgagataccaaatagttcaagaactagtaaagaagactacggaggaatagctagaagctaaatgaagaaagtatctcaaacaggaaggagtgatctgttaatgtgttaggaaagttgagttcttaggattaagcattgggtagagcaagatttgggaccttgactttgacgaacttggtggatgtcaggagtaagaggaggtattcaagagaatgttggagaggaatttaatatagtgagtattgaggacaacacttaaggagtcttgctttcaaggggatgtgagaaatgggttgttaatggagggtaatgtagtatcaaaaagctgtttattttgagatcgatgatatagtaggtttgtatgctaatgggactgattcagtagacagaaaaagcataatgcaggaaacagagggatattgctgaagccatagacctgggacacaaatagaagggttagttttaaagataggcccacaaacagctcattagtaacagcaggatgaagggcagattatggagttccagatgtttgtagtccagtagataggaggagcatgtcaaatttttgtgatattttctcagtgaaacaggaagcaagctcataaagagggaggaagtcacgaaggagtaaggaaggaaaaggagatgtaaaatgaatagataggagtgtaggaaagtaagcatactcttaggaaatctgtggtttatttaagtggtatcagtcaatgtggttctgtgtttttctccagttgagttcagcataggtgctatcactgaaaaagtacagaattcagtttaactaaaggtgagatttctctaggtgaataaaacagtcagtgatgagatgttgatacatttaagagaatgattataaaagagggatgtggaaagtagtctgggttaagtagtgaagtgagaaaataaagaaggttgagacagtggaaaatggaatgatcaattgtagattgcagtgtggttgaagatgcaatggacttcttgaggtgggaactagaaatttgggggatataaataagagaggggtgactgaaattgaaaatatgagagtataatagtatacaatattactaagtatggtatactaagtatagtagaatagtactaagtatagtagaatagtactaagtatatagtacttagtgagtataagttttaggatgtgaagaggggagtagcgtagaggcaaggtgatggaagcagatgagttcaagaaaatgagaacctaggagattgaaaccattatctaaatgaattctgaaatctcaagaagaactgtgctgagtgcttgtagtcattattttgtctttactactctgtgagaagacagcacttccttttgtgagtaatggaaagttctttaatatgtcaactgtaagatactttattacatttaattatctttagtaatgcatagtaataactaatgacctcagtaggattattcagtagatatgtgagctaaccccctgtgtcagacacctaagaggaacaactgatgtttttcaagacgaatagagggttctcatcccagggttttaagctgcaaaatatcccaccctatattttctgaaaacaaacgttatatagagtgtccacataaaagctaacaggaaatattacacacacacacacacacacacacacacacacacacagcattgaaaatgcatcaggaaagatataccctgtacccaacatgcacaaggtctaagcaatgaagaaaatctaggaaatcaaataagaccagaacatctatgactaatatataaatacttgaggcagttatatccatttaaaaggtgtcaattagacatgaaagaaaaaggccaggtgcagtggctcatgcttgtaatcccagcactttgggaggccaacgcaggcggatcaacgtgaggtcaggggtttgagaccagcttggccaacaaggtgagaccccgtctctactaaaaatacaaaaaaaattgctggttatggttgcacgtgcctgtggtcccatctacttaggaggctgaggtaggagaatcatctgaacccagaggtagagattgcagtgagctgagattgcgccattgcactccagcttgggtgatggagtaagattaaaatatatatatatacatttttacataagaaattttattttaatttttttgtaaattagaaaatagcaattaatatggtatttatataccagaatctttgaatatctaaaatttaagaagatgtgagcaatttcatgaaacttttcaaagcttagaaaaaggtagctatgtaaaataacaatgtatgttgtttatgggaacattagatgaagtaagtcatgaaaacatgcatagaaatgatcatataaacttgcaagaaattgaatgtcttgctatcaaaggaaaggatggaggtgtaagagactgaggtagaatgtgagaagctctgtatatattgtattttccttaaaaatatatatttaaactcgcatttcttgtttttcaaatgttcactctaatgaaaattcttttatttttcctgttacagtttttatttctgatctcatatatgcagtgtactgttgttcagaaatatcattgatcctccctgcaaatgaaatactctcatcctgttgaatttgagaatgtacacatgatttgctttggctttgaaatgtgagcagaaagaatgttttactttggggagttcccaattgctaaaccatgtgtcaaaatgaagtttttgtgacattacaaatggactaataagagtgcctttgttgatcctagttgaacatgagaaacttggttattgtaagccactgaaaaattttagtttcttttattactgcagaatagcctattctgtcctgattgatacagccacaacatttccttaagctctttgattttcatattgccattaggatgtagaatgccaagagaaggataaatcataggatcagagaatgttagcagtgaacgagactattggaatacattttttcaatggtttccagactttgggttctaagtaatcagtaatatttcgaaaaagtagtaaaagatatttcaatataaaaaataatgacatttaactttgaaaaaaaaaacctatcattgctaggcataatgggtctagcttgtaatcccaacaacttgggaggctgaggagggaggatcacttaaagtccaggagtttgaggctgcagtgaaccatgattgcatctccacactccagcctgggtgacatagggccacctcaacaacaaccaccaccaaagctatcattaatacattgttcctctgtctctcttcccatcctccttaccacttagtcttaaatctaatcttattaaacaatatctaaggaaaagataagaaaaatgatggttgcatctatactgaacatgtgttgacttttttcttgtcactattttctaaacaacacagtatcacaacttttgacatagcatttatgttgcattagttattataagtaatctgagatgatgtaaaggttatatgcaaatattatattttatataaaggacttgagtaattattactttaagtatccatggtggttcctggaacaaattcctcatggatatggagggaggaggaatcactgtaattaaacaaatcatcactttaaaacttaaaaccttttgcatgttgaatacagtcatgcaccacataaatgatggtggtcccattaagtttattatgccatatttttatcggaagtttcctatgtttaagtgtatttagatacacaagtacactgtgttacagttgcctatagtattcagtaaaataacatgctttacaggtttgtagtctaggagaaataggctaagccatctaggttaatgaagtccattctatgacatttgcacagtggcttaattacctaagggctttctcttcagaacctactcttgtcattaagcaatgcatgactgtagttggacaaaaaataataatgcaggcatacctttggcactgtcctaattcttaccagcatccatgattgcttaaatttgcactggaaagacttcaaaaaacagtgatatattaggacaatatatttccagtacatgacaaatgataacaacataagaactcgaaacactcaataaaaaacaaaaaataaagcaaaactagatgggaaaaggaagaagcaaatttcaagagaaaactcaaaaggccaaaaaatgtgaaatgatgttcagccttgctagtaattgggaaaaacacaaatcattttttttttttttttttttgagatggagtctccctctgtcacccacgctggagtgcattggcgtgatctgggctcactgccagctccacctaccaccttcaggccgccattcccctgcctcaggctccagagtagctgggactacaggggcccaccaccatgcctggctagttttttgtgtttttagtagagacagggtttcaccatgttagccaggatggtctccgtctcctgacctcgtgatctgcccgcctcagcttccgaaagtgctgggattacaggagtgagacacgtgcccgacccaaatcatttttaatctattagtcaaaaattagagctatgataatattaatttttggtgggagtgtggcaaaaggtactataatatactgctactagagagtaaaaattgataaattttgtaagggcaattttgcacaatatgaaaatataaaaatatgcttcatgtttaccatacatttatctagcatacagaattacccatgtgtaaacatgtatacagatgttcattataacacttcttataaaaacaaaatatttggaaataaatgttcatattaataaggcgcataccgtatgatcttagtccagttagaatattctgttttatttcaatcctttaaaagactcaacttctgactctatatagacgattaaaaaaagaatgtgttctccctttgtgcatttggtcaggtaaattaaaaaatacaccacatgctagccgcaccaaactggaataagcctttggaaagaagttgtccttgaagcttgtatctgacattgtagcaggacgagcctcagacaaaacctctcagacactgagttgtagaaggaagggctttattcagctgggagcatcggccagctactgtctcaaaatctgagctcccggagtgcacaatttctgtcctttttaagggctcacaacactaaagatttcacatgaaagggtcgtgattgatttgagcaagcaagggatacgtgacaaggactacattcactgctggtcagggagaaacagaacagggcagggagtttcacagagttcttttatacaatgtctggaatctgtgaataatatcagcttctaaatcataagttgatttttagctactgggtttaggccaatcaggcccaggcctggtttcaggcctggcgctgggctgcatgtctttggttgtacttcctggttgtttttactgaatagaaaacaatataaaacaaggagagggtctttgtctcctctcaatatcagcactggattgtagaatgtgttgctgattttgaccttgtattcaagttaactgttgcccttggtatctgtacatatctttgatttcagtctttactacacgtggcttggtcacttcatggctaaaaacatgcttgtggaagaccagtctggctcggtgagtctgtgcggccagcagtctctgatctgtacagggtattaatgtgtcagggctgagtgttctgggatttgtctagaggctggtaagggcttctggaccacttgtttctgtcctgtcagtctgtcagggttggaaagtccaagccataggacccagtttcctttcttagcttacgttatctaccagagcaccgtgggctgttacttaccttgagttggaaggggttcgcatttatacctgtaaaagtattcatccttttaatttatgtaaagtttttttgtatgccattctggatctttaaagagatgacaacaaattttggttttctactgttatgtgagaacattaggccccagcaacaggtcactgtttaaggaaaaataaaagtgctgccagaacctaagaaaaacattaatatctaaaaggtcatttagatgatttccatgagagactttttgatgttctttacctgttaggattattattgataatccttttcagattatgaataaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtgggtatgattcatagtatcaattgcggaattcactgtgcttgtaggaaatagtattctgatcttatctgtgaagcttgggcaacattttacttcacaggtaagtattctaagtaaaagagatttctgagggaaaatctatgtagtattcttggcaactttatattttgtttctgagataatctttcttcaccaagagccctccaatgtgctgttaatattttcaagagatagctgcctataccaagattcaagaatcttttatactattgattagtttctagaacattcaatgatacacagtaagacagaatttggtacttatgaagactgtttaatttgtaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggtaagtgaattctagtttcctttaaaaataacagacaggaaaatggtttctctctcttctttcttgctccttttcagcagaaaattttccgtattttatttttttaattttacttcataatttaaaactcaaaattaactgtttatttatgttcaacttttgtgaatatttgtgtgtgtgctatctactaaagaggtaagttaaagtttaaatcagaatttgcttctaaagcaaaacatcaaattttaac

SEQ ID NO: 528 - DNA, 61042 bp, Homo sapiens
tataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatgattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaacaatagccaagtgtgtttcttttcttacatatacagtaatacttatatttcattaatttttagtaaaagctctaattagtaatcaacttgtaaaattcacaaaaaaaccaatagtattaaaatcccacttaattgttgaataagtgtaagataataatagtcagcaagttgttatgctttagaagactgactttaacctatttaagctatgaactcagaaaagcatctcaaccaatatgtttgttgccattagcatcatttaccgagctgtgtacctttaatttctgccattctataatccttccaaggagtgtttttatcagttagttagggatagctggtttaatgctgattcccatgcaaagttagcccggttgtatgctttttataatatgcaagtacttctggtgttaataaggttaaaaaatagaagaaacctaaattatacaatctacagttatcagttctattgagctcactggaatcttctcctactttatagacttccttctttttcatttttttcctaattgcttagacttgttgtatatgactttttgttctttttcttattctacaatctggatatttatttagggctttcatgacaccttgtagtctgggttttcttcccaattctctacctattcattcttcttcatcttgactttacatatggaattcattagggctctcatctaggtttccttataactctcagttgttttgtttatgcttaaatgagaacatagaggccataactcagaaactgtctattcttcacctataaattgtccctgccacaaagcagattcactgtgcattggtaccacttcggctcactgcatcttgggctgcagtttctactacttaagattgagtccagtgatttagaacatacacacaaaaagttgcatgaagcaggcttattgcttatagataggcatcaagtgacacagaagcccggcgttcaggaggagccagcctcccaagactcagaccgtttgcccagggtgttgaagactcatttgcacatgccctatttgtaccacagctgagggacccttgaaagaagcctgccccgtgttttataacccaggcatcccatgatacactgggctaaagcacttaaggaaatgttctaagaggcacagtaagagagtctgagacttatctcaggatgttgcattcccagctcattctacagctattcttgagatgcacaagttatagaggaggaaaacctgggttgctccaaggccacttggagagttgtcctgcatttcctctagcattttccttttttttctcctattacaataaagaaagtacatgtcattctaagaaaggccattttctctgcttaagttaatgataccattccatttttatcttttggaggactttagattatcctccctcttttgatttagcagtctttccctttcttctgcattagtcatcctagattacatgtattacagtcttccaattaaaaacatcaatgaccatcctcagatattcttctgggtatattactttgctcatttccttgctccctctcctaattaaacatctctttttatcacactgtctccacatcctcagcctccgtcattattcatctctctactgtccagttttcaccattatcacttcattcagtctgctcttgtcaacatcatgagtgacatttatgttaccagtccaatatatttctctgtcctcaccttaaaccacttcatagcagtattaatgatggtgggtcactttctctttctatcttccttttttcgtgttattctactctcctggttgccttctgtctcattgattgctctgtttcaggtttttgtttttttttttatcttattcttaggtggatcatcttattctgttccacctaagtcctaacttttatctatttctcttctttatcttctcttctctaggtgattggaatcatttccatggattttaaacaaatattttctgtggacacctaggtatcttcaattcagaacttggacttcagcctcatacttccatcagatgcttgttatcaccacttccatgttccacagacatctcataattaacatatttaaaatggaaccctcattttttttccttgcataaaccttttactacattattttcttactgcttagaaacccaggatattttctgatttatctctcttagctcaacaactttatctcttcatataaaccttagcatgaactattaattgtatcttcaaaatatctcttcatttattgcacttcttttgtatcttctatcacccctttatccagctcacaattatctgttctctgcattccaaaacaactctgcaactggtctcctatttccattattttactgtctccctttattttactaaagaccacaacattatattcatacaatttaaatccaattaaaatgttaatgcttaaaactcttaaatttttattgcattcagaataattctaaccactcatggtagcctacaaaatcacaccttatcagacatgaacctcagttctattcttttcccttgacaatcccatagccttaggtattctggtctttcgtcattttattaaatatgccatgtatttttattttatgttgtggactttttgtatgtgtttctccactcttttggaatcctcttaactgagttcttagcatggttggctcctgtttttataagtactcccaaacacaggaactagcattaccattttttcagtcctgcagttcagaaatctggggcttacgtttgaaaccctcttctcttacatttcccagaacaaataaagcactgaatactttagatttttgcattctatttcttcactatattattttctctttctacttctactatctagtaacccttttcttcaatgaccaaaatctattttacttccagcaatatggtgaaaagactatcgactcttaatttaaagccagactttattgtttataacaaatgcattgcagaatgtaaacagagaatgtaatcacaagccaggggctgggagcacttcatattagtttcttaacatgtcagaaccacattctttcatttttataagagagtaaccagagagccactttaagaatttttagtggttagcagaggagtagaggagagtgcccttgatacacaggtagtggtgaacatgtatctttacccccagcaggagagaaaagataaacattagagacataagctagcaagcttcaaaaaggatatttgaaaggggttttgtaatgggatatcagtttttgtacaagggaatttatttgtacaagaggttacggagcttttctcggagaataaaacaagcctgtctattacttgaaattttaacttttagaatagcttacgtgcacttatgctgattattgaggggttgactgcagcatcagcgtccacttcagtcctttctccaaccattccattatctaccatgcgatcagagtgatcttttcaaatcagataaccaccaccacttaccttaggataaaaagccaaaattcttatcagggcttgtaaccctgtgcttgaagtcttacctcactcaattctcctctttaatttctgatctctaaccatgctaatcttttagttactgcaactcaacaagatctttttagttctttaatttcaattcaagagacattctgctctttctgcttggaatgctcttttcttacctcttctcctaattaactcctgttcatcattcaaatcttaattcaaatgctgatcctgcatgaatatttattcagtattaggtcaagtcccctgatgactgttagcaatctctgtacttcttatcactcagcatagtactgtgggaaatatctgcattgttctttattgaatccttagtctcaggacattatccagaatgtcttacgaagagatcaataattatttgtaaaatgaattgagataataataaaagagaaaaataagagaaaaaatgtatctatttttgagaaggagaacatttttaatgaagatgtggccctggaatacagatgtttctctcatttttttcctatttcttcccaaatttaattaatttctggttaaccctgatttctcagatcataaaaatcatggggaaatcaactactttggcaataacccatcatgttttcaggatttgtaagccataacaacagtaaattctttggtgagctatactctcagtaagtaaatgaagaataattcaaatattattgggaaaatgatgccacattcatctgaatataataaatgtgaaattcattttactatgttcttagaactttgtaatactaatttataatagcagtttcatcctttagatatttcattttatctacggatctaattcttcctgtgaaattactgagctatttctctattcttagaagagaaaataactctttgtgataaaaatcattactatgtataattagacttccgtttacaagtcaaactgaaccaacgaacttacaatcatagaatgtgactagtcacagggaatggttggggcattagctcagtacctgtccaaagtgagctcattattatgattattagtatcaccattatcaatcagcttccacataaagtgtacctaaatgctagatctatatgatagcttccaaaatgacactgatttttaataatccaaatctttaaagagatcactttccattttagaaaaatgagatttttttttttttggaaaagatagaaaaacctctaagcattttaaccaagggttttagaacactttatttttatgaatatatcaaagcaaattccttctttattttgaaagtgactggaaacaatttcacggtcttactaagggctagtttaagtgagtctcaatttttcttctgttttgtttgctcttacaactttcctcacacacacacacacacaaagggagatataaaaaaatctagatataacagatgcaacttacaattttttggtaagaaatcataaagttttagaaaaaatcatttaggagtgtcaataaaaacgatatttaagaaaacagtaggaaaagtgatatattaaaagacttttaaacacctttcacaagaaattgaacagatgtgcaaatacacattatacgttatctatttgctcattttatcctgtccttaaacataaactttgaagataaaagaaagaagtgtggctcagggtcactcatgtaatctgtttttaggcagaaacaggtgtgttgaaaggtttttaggtaaaacaaccaccacttagacttcaataaagtagtatttattattttcctataattgcaaatttaccaaatgtaactcactattttttctttaatattttcaaagatatttttgagtaattattatattttcacaatcaattcagtagacatttttgaaaaacttatctgaacctagttttctcatctgtgaaatggaaacaatatatactctctcagtttgttgtgtcaaatgagaaaccatatatgatatactaaccactggttctggctaaatgcatacctcctcatcttttcagtaaagacatgactgttggccaggcacggtggctcacgcctgtcataccagcattttgggaggctgaggcgggcgaatcacttgatgtcaggagttcaagaccagccggaccaacatggcaataccccatctctgctaaaaatactaaaattagccgggagtggtggtgcatgctggtagtcccagtcccagctactcgggaggctgaggcaggagaatggcttgaatggcgctgggagattgcagtgagccaagatcatgccactgcactccagccttggcaacagagtaagactccatcccaaaaaaaaaaaaaaaaaaaaaaaagtaactgttattctcagtactttgggccagcacagtactgatactctcctaaaatctaactcaaagagaaaaatcacaaagcattggaattggagcagaaagtaatgtattcttgtttgacatctttccacattcagtctgtgtactgttagctgaaagctagttgacacaaaatgctgtcttaactttagtgttgtttctaatttagttctaggtcataaaatttgtaggaaagtctaattccaaaactttatcaacagctttgttacgctcaggtattatgatcagatatcttatgtgtgctctatgacctcaagcaaagattaaataaatctgtacattacagtgaagacccacatcaaccaatgcaacatacatttatttttcgcagcactcttttaggtgctttgaaacatgtaacccatgtttaagtgcagaggatagctggcaaggcaaaatataactatatgatgtgttaataagaatacagaggaatagttaaagtgatgcataataaagtacggaaatatgttgtttgatttcaaaggaaggggatagtacatatgctgaaatggcctgggaaagcttaatgataaggaaggtcttgagatgggtaagagagatttgtaaggaagagaaaggagggaaatttattccaaaagaagaaaaagtatgacaaaagcacaaaggaataaatgagatgaatggcagaaaatagatcagttaatcagtgaggctagagaagcacgtttatggaacactagtgaaaaatatgatgaaaaggtagaatgtgaccaataacagaaggatccattttctatcaagactttcttattagatttgatatgttcataccagcaatgtcatctctgaatataaaagatatctgtacttacgcaacataattatatgttatcactgggaaattctaggaagtaattatcagtccctttattaatattactatagaattaacttattcagttatagggtacactacgtttatagtttacttccttcctcccccagcctccagctttgtaatttaaatgaaactaaattccatcataattcactcactaacacataggactgccaacctctgaatggctttagatttgcgtgaacctgtatttgtcaatgcttgctccaggattctattggcatatgtcgaaataattgatttttatgacaacctgcttcctgcttactgttttttaccatagggagggaaaaaatagaattatcccttgatttagctgtcagtcaaatgacaactcaagcatgctataaaattaaagaaagccccacattctaccaggaactgatgattttagtgatactgctctctttgtagaagaaataaagtattttcatatcttatgatgaatatcactataatacattaaaatatagaattgcatccagcaaaatatcctgaagtggacaaaatatgcccctccaaaatatgccatttttgcacaataatttttttgagcagaaagcaattagctcactgactttcacctttctaaaagcaagacataaatttcaatttgtaaagacgtctccctttagtgtacttgtaagaaaactactccatagacaactcttaatagctgatgacttatctgcataagaaactttattaaacaatcctgatttagaatacatttcttcccccactttcccgtaacttacctcctgcaccgagcagccctaaacttcttttctttggctagtctaagatatacaccccaaatcctaattgcctctttgcatcacatttctttgtgaatttccatgtgtatgtacataattaattgttatttttcttgttaacttgtctgtgatcagtttaatttgtagggtcccagacactgaacctaggatggaagagaaaaagtgtttctgctttcctatggcttaggcaaccatgaatggacaggcagggcatcccacttgctccagaggctgcagctcaattgagatctgacaaagctgatgtgaaaactttactgaaccagatcctggaattttgcctacaaaaatacaaatacagaactctgttttttcttttccaaattcagatttgcacgagaataaaattataagaattagttctttggaatgtgattctggtgaattttctcctgagtatcattggttattgaccctttcactcccagggagagccattgctttcctgtgtgtctcattttgtgtcttgagcgcttggattcactttcttcctggtggcagggtccacattgttgggcttgctgtacaggcagtcagtcatcagattgtatgccctgagaatttgtagatggtcagatagagatgcaggttgcactgtcttgctactgatgttctaccaaccctctcagagggtttgtctaaatttttatttcttttggctattgctgggaggaactccatatcataaggacttcatttttgcactctctttgtggatacctcttacgttcttggctatctacattattaaatatgttttttccctctcttattaatcttttatttatttaaaagtggtgggttcccatggccttgggcatctctgcctctgtggcttcacagggtatagcctcatcctagctgctttccccggctggtgttgagtgtctgcagcttttccaggtgcagggacaagctgtcggggaatctaccattctgggatctggaggaaggtggccctcttctcacagctccactaggtggtgccccagcagggatcctgtgtgtgtgctctgaccccatatttcccttctttactgacctatgagagtttctccatgaaggccccgccactgcagcaaacttctgcctggacatctgggtgtttccatatgtcctgtgaaatctagggggaggttcccaaacctcaattcttgacttttgtgcacctccagctcaataatacatggaaaatgccaaggactggggctaccaccctctgaggcaatagcctgagctgttccatggccccttttagccatggctgaaggggctgggatgaggagcaccaagttactaggctgcacacagctcaggggtcctatgcccagccgaagaaatcactttttcctcccaggcctctgggcctgtgataggagagtcggctgtgaagacccctgacatgccctggagacattttccccattgcctttgagtttaacatttggctcctcgttacttattcagagttctgcagctggcttgaatttcttctcagaaaaagagatttgccttttcaatcatatcaggctgcacattttccaaactcttatgctctgtttcccattttaaaactgaatgctttaacaatattcaagttacctcttgaatgctttgctgcttagaaacttcttctgccagatacactaaatcatctccctcaagttcaacagttcacaaatctctagggtaggggcaaaatgccactagtctctttgctaaaacataagaagagtcacctttgctccagttcccaacaagttcctcatctttatctgagaccacctcagcctggattttatatcattattgacattttactcaaagccattaacaagtctctagggagttccaaaccttcccacactttcctgtattcttctgagacctccaaactgttccagtctctgtctgttacagagtcccaaagtcacttacacatttttgtgtatcgttttagcagcacttcactcctggtaccaatttaccgtattagtccattttcttgccgctgataaagacatacccaagactgggaaatttagaagagaaagagatttattggatttacagttccacgtgcctggggaggcctcacaattatggcagaaggtaaaaggcatgtctcacagggcagtagacaggagaacagagcttgtgcagagaacatccccttttttaaaccatcagatcttgtgagattattaactaccccgagaacagaacagcatgggaaaacctgccaccatggttcaattatctcccattgggtccctcccacaacatgttgaaattaaaattgggatttgggtggggacacagccaaaccacatcattggggatggaactttttattgtgagtatgtctgcacaagttacctgtgtagattttcttgtctgtgtggctgtgggaatgtcttagtcaaacacccctatgcaagtttacttatctatgactatagtttgattttttaggctgttcttttgtttgaatgaattcaactgagtacccaccctaactgcctgcctgactggtttgtttatttctcctctctcatttttacccacgggagtggagagcctaactgctgttagcgaggtggggtgatgctcgctacttcctgctggaaaggggcattgtatggggaacagcagctagggttccttctgtgagctttctaagggtccttggaagaaatttgtgtccatgcatggtttcatttgcatcaacatttgtagtttgatagactttaggcaagaaaaaaaaatggattattagaggacatgtataaaaatgaaacaaggggataggtaatgaaagctcaaaaatctcaaggcttcagccatgcccagataaatagtggctatagttatgcctactaagatttgggtgcatggggctttgctttggtgaacttccttggttttattttcccaaacaaagaaacctctgggttatgggtaccctgtatactcccataacctggtaggatttgcaggataatagcccaaaactagaatattgattcagatttttacactacttattccttttttattttgagttgcagccagagattgctggtttgtttacaggaataagcagagttattctaaaatgtacgtgatatggtttggctttgtccccacccaagtctcttctcgaattgtagctcccataattcccatgtgttgtgggagggatctgtgcgagataattgaatcatgatgggtgtttttccccatactgttctcatggtagtgaataagtctcaggagatctgatggtattataggaggaaatccctttcatttggttttcatcctctttcttgtctacttccaagtttttgccttccatcatgattgtgaggcctccctaaccatgtgaaattgtgagtccattaaacatcctttttaaaataaattacccagtgtcagatgtgtctttgctagaagcatgagaacagactaatagagtaggcaaaacttaaaaacaactaatgagattagaatttaatgacaagtgtatgataagttttgaatcaaattttgctctctccagtcctcatttttgttcaaaacaaatcatgatagtcattttgttaaaaacaaattacgactgagttgtttgcaatgtaaacttaggctcatacttggcttgattatttgcataatgtgcagcaaaaataattatttttgcagtcttttaaaataagctttgatggaactctgttccacaagagatctcagataggacttttttaaagccaagcccggccatgagtttgtaccctcaaatacctatgagttgagtgaattcctctcttcttaatgtcacaagaatatgtggttcctgggactgttatatagtgacattctttactcatcacagattagaaaccccgtacacagattatgtagacaaggtaggaggccacatttcccaatgggcttttattggctctgtaagtgaagcttgattcctcaaagagaagcatatccatccaatcaaagccttggtaaaacaaccagtttctccaattgtgtcatgttgcaaaagaaaatgaattcttactgcactggtgcaaacaacgatattgccataagtttagaatattcccaaatagtttccaaattctggagtaacttggcagagagaaacaaatacgctccaaattttgttcactggtgtataccttacttaattcttaaaagctgtagatagcttaaaagaaaggtttccttaactctgaagaacaaaacaaagaacagcaatgttttaagcaaaaagtaaaaaaagattatttcagacttctattagtttagttcatgcagttaactcctgtctgatattcataaacagttaagatcttcatgactcttgtatgatttcttttattctcatgtcatgatttccaaagttatcagaaacctgcatttgagagcacattgtaaagtcctacagctgattgtaaaacatcttttgaagaggattaaaacaagacaacatttatctgtagatgacatagtgttcaggttagttacagtgaaaaacatgactggcaaagatatttggttatttctgtggtttgcaataacttaatacaataatcctaattatgatccatagcatattctcaagcattagaatttttaaaatcccatacaattttggaacatatattaatattatcactaaaatataacctgaataaggttaaacataattttgtcaatcccacttacatgaacctgtcaaaaaattctgtttacttctcttctggatgcttcagggccctctgtagcatacaaaaggtagggttcaggagagacaattttgaatgtgaagtttgattttgggaagcctgtcaaatgttacaggtttaaaacacttgatagtgtgaaatacaattccaggtaacacataagttatttattttggcaaaaggatgactcagaaattttaaaactaggcaacatcctttactccttaagagggaggacttcgctttccaaacagtttgtctcctgtctactcttttctctctttggcagtctcccaacaaggcaaacaaaatatttcattattcttctctattacatgaaaaatctgtacaagggaaagaaagccaaattttacccttacattggtttcaaaataatcctttttcattggcaaggtttatattttatgcctttttataatcttttatgacaaacacattttactgttcttacacaccttgcaggtaaatttatttttagttgtcttatttacatgttttaatggtaaatcttaccaattttaacgttaatataaaacctggtaagttgttttaattatgtactagatgcagataaagtctgatttttccatcatatttaggggcatggttaatttcatatgtccccaggccttaccaagttgtaaggtaggtagcatacaaccttgaaacatttagcaaacctggtatctaacttacatgatttaaactttctatttacattttgatgacatttgcattgtaccaatttcatctttaaaacaattactatttcttagaggttaaagtcccataaactaaaaggcattagagttttaactttcctctaaaatatttgatttaagtgcttatttttatttaaggcaatcaattagagctcattagagacatcacacacaacacatatatcactacacaggcaaacagaagaagatccagtagttctaagatttttttcttgtcccatttcctaattgaattattagctttccagtggagccctttaagagcaaggatagaaaaccatgaagtttctagggcctaatcaacttgtatagctgtaagacaaaagcagattttgagtggaatctatctatgagcctctaaattctggtattccatgaggaaaacagaggtttctcccaaaatggaacccatcatgccttttctgtttttcccaagaagtatcaggccagcaaaagttatcttgggttcattaagagtggaaagacagagtggagaaaacttattcagtcaaaacaaaagttatcttgggttcattaagagtggaaagacagagtggagaaaacttattcagtcaacacaaaagttcttttcaagaaaaacacaatccaagaagagaaaaacataaaggccttttaaatatacctataacatgaatatccacttttaatcaagctgagcattctttaagaaaatcatttgaaatatgctgttacctgactttagctaaatcaagcaggtaatatttctggcttttgactttaccaaaagtaatatcaaaggtgaaacaacaactctcaattaggttataagttaaccacgagtatacaagatatcttataagtggtggtaagcagcttttaccagatctagaacctttaaagtcaattcagagaaaagaagatttcagaaaggaagttagagttgttcatggaggaggaagagaagattaaaagtcacacagctattaacttgtaagtattcattacccaaaccaggagcgaacccgggccaccattataaaaaggcaatggctaaaaagaagtactgccacattgttacaggttatggtcaaggacataaaacaagatggagacttgcagcaaagtttgttactaaccagtttacaggggtgacttgaacagtgagcttacggagtcccaggcctggattccgttccaaggtaccctctctctgattgtttcttgtattttctctcctttttctgagactcctcctagtacctgttatgaaagactggggtggctactcttagaaggttttttaaggtgccatctggttctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagggttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatttcttccaggcagaagctagaaagagaggtttgaggtttaacagactgtcactatatatgcctcccagctgtagaaaattaacttgtctcattaataaactgttcaaattcatttagcagtggtgagcttttacatgaaggaaaagcaactaaaatggagagggatgagggtattcactcgggatgaaatatcttttcatagagtaccatgaatgactgttattgtgggacaaaaagcacttactgggtgaaggtttagactgaaatcttgaaatcccctggtattttgagtttctgcttagcctttccaaaggaataaaatcagatatgtatctatctcagtgagcagaggagtgactttgagtagaatgggaggaaggtttgtcctaggcagtttcccgcttgaattttccctagtgatttcaggggcccagtatattgtcctttcacacatctgacaagtaattgataaccagaatatctaagcagctcaaacaattctagaggaaacatatctaatagttggatcaaaaagtgggcaaaagatttaaatagacatttctcaaaagcagacagacatatggcaaacaagcaaatgaaaatgtgctcaacatcatcgatcagagaaatacaaataataactacaatgagatattatctcaccccagttaaaatggcttttatataaagacaggcaataaggattgctggtgaggatgtggagtaaagtgaaccatcatacactttttatggttatgtaaattagtacagctgctatggaaaacagtttggaggttcatcaaaaaactaaaaatagagctatgatgtgatccagcaatctcacagctaggtatatacccaaaagtaagaaaatcagtatattgaaatgatatctgcactcccatgtttattccagccctgttcacaatagctaagacttggaaacaacctaaatatccatcaacagatgaatggataaagaaaatgtggtacatacatacaatggagtactattcagctataaaaaaaaatgagatcctgtcatttgcaacaacatagatggaactgtacattattatgtgaagtaaaataagccaggcccagaaagacaaacatcacatgttctcatttatttgtgggagctagaaatacaaacagtggaactcatggtcataaagagtagaaagatggttactagaggctgagaagggtggatgggaagcaagtgggaatgttcaatgggtatagaaaacagaagaatgaaaaagacctagtatttgacagcacaacagggtgactatagtcaataacaacttaattgtgcattttaaaataaataaaagaatataattggattgtaacataaaggataaatgcttgtggtgatggataacccatttaccctaatgttattattacacattgtctgcctgtatcaaaatatgacacatgccctgtaagtttatacacctgcaatgtaccaacaacaattaaaaatttaaaaaggtgtatccttcccagtgaaccaaaatattttacattgataacttttaagttatcatagtgtgttggaataatcacagctttggaaagaaaaaaattatagatataaactttcaaagatggcaggagatatagatctctctttagtggattaaaatatgccatttgttattaacatcacactgagattttttaacacaggacatcttctggaaatgatatgattataggagttataggaaaaagcgttttttcatactgtgattacctatgctatgaagaaaggagatatttcctctatgatgtctaatttagcataattattgtttttaaactatatttagatttaattaagagatacacaaacaaattacttttagtagtaagaagatttttaaaaattttttgtgtaagatgactatgtagtaaagaaggttacaaacttactttttaacgtagaaaaataatctcaccttcttgccccatggaaaattgaaatgttatgtggaacccagtgtagaaaaactctcagtgaggttttctgtcttaagtttcagtggattgaggtgagatcaacgcctgttccacctttttcctccctgtcctagcaggcttgaaaacatttatacagccataaaatgttgcctttaaattcaagtatagaaaataaaatttaaaatgtgatatttttatatattttattttaatatcttacatgggaaatgtttttgaaatgttaaaaaattaaaatttttaaaagagtactgtgaaataatctaatcacatgtggaaattttgttactatttccccaagcatttttggtacatttaatgagttgaatgtaactcataagtagataaaaatgtttaatatttaattttctgctgcaataatgttacaaaacaaccttaaattctcagtaacgttaaacaacatatttttttctcccaaatttccaggttatttaagggcagttctgcttcatattgcagtttgcctgggctttactccaggctgtgtgttggagttaggtctaatatattgtatccctacgtatcccagttagaaagcctaacagatttctttgtacttcagtcagctcgattgtatttgtcattcaaaagccaaagcatttatcctaacaccaattgcttcttttttttttttagatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtaagccactgcacccagcctaactgactgcttcttttgttctgtagtctttctccaaaactgtttttctctgtactcactttcaccttctctcacacatatatgtccctcatgtccctttatgtctccagggtcttctatttccacgtaatcttaattgttcatcatatcctggactcatgagtaattaatctgttattctccctgaaagtgcagccttgttgaatagaatgtgttctttaaagagcagctttgtttctcgagtgaggtattaacttccagatttaagtgaaaatgagttccaagttttatgtttcattgtgtgtctaagactgacaccgtttattactgtggcacttacagcttgctttcaatgcctccaaattctctatctgaagggctgggtaccatatctcatgtctgaacatattcctcagaatcatgcagtaccagctatgttccttctttatattatggctcctgaggtgcctgttaagcagccaggtgaaattgccttttaatcagtataggaacagtctctttcctgctgatgctaatgctttttgtaaaaaggtcatgctgtattgaagttcttctttcacggcaaaaccactaatggaactcatctacttactgatgggtggaagctctttgtatgccaaagtcttgttttgtttgtgaagaatctctttccctcaacagtgatgtgctacgttaggtctcaaatcattgttgctttttaatccaaatttatgacaaagattttcagtttgtatgcataatttccttctctggccttaaccatcagtctgtggacttgccaagcaacaaccacaagaacaacaagtctgaggtcaagagacactatttagatctcagaatcatttgttgtcctttatcctttgacaaagttttgcctttctttctttatgagattttttccctaatggtttctcaatctcttgagaagaagaaagttcttgactcttgcagtctttctcattagttgaattataccatcagtacagcttctgatcatgtcgagaaatccaccatgaagaaataaaacatttccgattacatggattacgtttcttggattcttataggcattaaacttcattctaggatacaacctcatgatcttgtcttattctcagaacaagaaatatattactatatacattacaatatatatatattgcagtttccttgctatatatatatatatatgtatgtattatagtaaaccctgtaggcaagcaggaacacttcagaagtctcaatgaatccatcattagctgttagtaatgacaacactgttagaattatttcaataatcacacattgttatggtctgaatgtgcacccccaaatgtaatatgttgaaattttaacacctgagggcatagtattaggaacttgggagtggaactctttttagtgctattatgaataagatgcttgccttttccagcaaatgaggacacagccacaagctgccctctaggaactatgaagttagtcttcaccagacacaaaatctgcttgattttgaatttagcctcccgaactgtggaaaataaatttctgcttttataagccactcaatttatggtatttggttattgtatcccaaacagactaaaacacacattatttacctcctttttggactgtctggggttgttgctttaaacttgcttcagtgcctagaactgctccaagctccctgtcctctggcacacacgtataaataattctgctggaaaccgacatgtttcactcagtcatccaaatgtatttataatgttgtccaaatatatagcacttgttacaatgtttacattttagacatattttgagatatgtgccttaacagagtgctgtgattattattaatatttagtaacttatcttaccagacctaaactcaaagtttttcacaatggcaatgccttatttgggacttatttgggactgaatgtatgaagatcttacattgagtccaaattgatttctctgttagtctcgcaataacattaaagccacagaattatctgctgtatatttcttgtcttgttgtagctgatattctacatattaggacaattaggacattagtaatatctattaaccttagaataaaatgtcatattgaaattgaagaggaatattggaactttgctaagaaagaatgcttttcacacacaatgatatctaaaatggagcctctgttcctggaggtatattttacaaaaattcagtgttactataggaattctgtacacttctttcttagacatttgtattccatcagtgtcagtcctctctgtattttaaactaaataggatttctttttccatctttctgtttgacaagtattgttttgctgaaaatttgctattcatgttcttttaactcattagaaagaatatttagggtctttagtgacaaatgacatggtataaatgaaaagaaaacactgacattgtaattgagaaatactaattaattaggagaatattatttaaaaacattgtttaaatatttctttgttttattattattatactttaagttttaggttacatgtgcacaatgtgcaggttagtacatatgtatacatgtgccatgctggtgtgctgcacccattaactcatcatttagcattaggtatatctcctaatgctaaaccctcccccctcccccaaccccacaacagtccccagagtgtgatgttccccttcctgtgtccatgtgttctcattgttcaattcccatctatgagtgagaatatgtggtgtttggttttttgtccttgtgatagtttactgagaatgatgatttccagtttcatccatgtccctacaaaggacatgaactcatccttttatatggctgcatagtattccatggtgtatatgtgccacattttcttaatccagtctaccattgatggacatttgggttggttccaagtctttgctattgtgaatagtgccgcaataaacatacgtgtgcatgtgtctttatagcagcatgatttatagtcctttgagtacatagccagtaatgggatggctgggtcaaatggtatttctagttctagatccctgatgaattgccacactgacttccacaatggttgaactagtttacagtcccaccaacagtgtaaaagtgttcctatttctccacatcctctccagcctacaatgaactcaaacaaatttacaagaaataaacaaacaaccccatcaaaaagtgggcaaaggatatgaacagacacttctcaaaagaagacatttatgcagccaaaagacacatgaaaaaatgctcatcatcactggccatcagagaaatgcaaaacattgtttaaatatttctatcacaaattgacagcagtacaatgcacaccaccagcaatgtataattctagatatgagaggtaaaaagataaaacaggtattgcattttctccagaaaacttatcatttagtggaaactggccaataatttcttaggccttaggataattttacctttgattctctagttaatccaaaatatataaaaatattaaccaaaagtatatatttttaaaatgcctacataatctaatgcagtattttttgctctcttcttgaagtgaattaaattccttatcactgaccataaaattgaactccattgatgattcttatttaaaatagttaaaagtgaatgtaaagatcagttgtggttttccttttcttacccttgtttttacacttatatttgcctgtgtcattcacacacttttagaattcaaaacaataactagaaatgtaatcatttgcttttcaaaagcttttcgcatctttccaaagttaatataaagtcttacaaaacttttagctaattcacaaaaaaatcaaacatatatagttgaagcaattttttttttttggtagatttcttcaaaccacagaaatttcagttatggcatggtaggtcttttgaaatgtttcattttttgtatttgaagatgcagagcaaaagtatttccactccaactcccctttaataaaaattgaatgtaacaaaaaaatcaaaatctataggaaaataaccccttcatctatgttaaaactatgagatttccagcccaaataagttataagaaccagtatagagtccaggctcggtggctcacgtctgtaatcccggcactttcggaggctgaggccggaggatcatgagttcaggagatccagaccatcctggctaacatggtgaaaccctgtctctactaaaaatacaaaacaaattagccaggcatggtggtgggtgcctgtagtcccagctactcaggaggctgaggcaggagaatggcccatacctgggaggcggagtttgcagtgagtggagattgcaccactgcactccagcctgggagatagagtgacactccatctcacaaaaaaaaaaaaaaaaaaaaaaaaaaaaaaggaccagtatagaaatactaatacagtaaaaggtggacttatatataaagaaaataaccaacagattttgtctatggcacaaacttcttagaaattttgaggtctttagccttaaagacctaatcaaatatttattactttgaacagtgagctactgggatatgctgggctttgagcctatgtacaaatctaattttagaagtcaggacgtgttgtaagcaatagcaaagaatatgctagatgatcagcttggcaattgttgaacaaacttcattcagcagtgtgaggacgtaattaaagcagttgaccttcaatctattcactctctttattggcaaatggccgaggaataagactagaaggaagatgaactggtttagtctctttgtcagctgaacttgtggtgaaagagactactgatattttctaggatgaagagatcttatctctgaaataccctttgcaggttgctcctgactgaaacaaattcacagattctttcttctcgctcaattttgctgttgattcttcattttacattctttatttcatttattttatgctttagctctagaattttagtttgggttctattttttcaatctgtctgtggaacttctcaattggtttgtgttttgttttttttcaagttttggttgaattgcctatttattctcttgtaactaattactctcctttaaaacaattatttgacatgaaaaaccttgcaaaaatacaaaaatctataaacttcttgacaaagaattcaaaataattattttaaagaatttctgaatttgcagcaaaagtttgctatagagcaacatgaaagcacagaaaagtatgaaactcattgattaaggtaaatatataaaaaatacagaacactctaatagtgtagtagtggtgtgtaaatcagttttattgctagtatgaagcttaaaatccaaaataataataattatagctacaataatttgttaatagatatagaatattaaaaatatataatgtgacaccaaatatataaaatatagtgggctgagtaaaagtatagagttttgaatatgatcaaacctcagtttaaaatagtttgctccaactacaagatagtatgtataagcttcatgctattcggaaagcaaaaacctatagtagatacccaaaagacaaagagaaatcaaagcatgtcactacagaaaatcataaaatctcaaagaacgacagcaagggagaaataaaggaacaaaaatatgttaaaaggctgaaaagcaatgaacaaaatgtcaattgtatgttcttatctatcaataattaccttgaagataaattcattctattctacattcaaaagccagagtggctgaatggattacaaaaggagacccaacaatatactgcctacaagagactcacttcagcttcaaggacacatatggtgtgaatttaggggatgagaaaatttgatattccatgcaaattaaaacaaaaaaacaacatggataactatccttatatcaggcaaaatataccttaagataaaactctaacaggtgataaagatggtcactatataatgataaagggatgagttgattaaagggatgaaacaattataaataaatatgcacttaacattagagcacttgaaaatgtaaagcaaacattaatatctggagggagagatacagagcaatcaataatactacagatataggtaaccttattgacactgttgaaattatcaatactccaattacaacaatggatagatcatttagacagacaatctgtaaggaaaaaaaaattagacttgatctgcactttagaccaaacggacctaacagatgtatgttcacatttcatccacagccggagaacaggtgttcttttcaagctaacaagaaacatcctctaaaatagagcatacttgaagtcacaaaatgtcttaatacatttaagaagattgaaattttatcaagtatctcttttgaccacaatggtatacaactagaaatcaattaacaggaggaaaactggaaaattcaaaaagaagtgaacataacacaattcttaaaaactggtggtttaaaaaggaaataaaaaggaaaataaagaaatcttgatacaaaaatgaaaacacaatacaccaaagcttgtgggatgcagtaagacagtgctaagatgaaaatttgaaatgacaaacacctacattaaaaaaaacacaaatatttcaaataaacaatctatcattaaacctcaaggaactagaaaaaaagaagagcaaactaagcccaaagttaatagaagaaagaaaataagaaagatcaaagcaaaatagagaaatagagagtagaaaagtaatagaaattgaaagacattctgtgttcatcaatgtgagaaattaatattgtcaaaatgctattacacaaagcaatctacagattcaatgtaatccctatcaaaagtccaatggcatttttccagaaacagaaataaatcctaaaatttgtatgaaattacaaaagactataattacccaaactgatcttgagcaagacgaacaaagtaggaggtaccacacttctcactttcaagttatattactaaactacagtaatatatatatatatatatgatactggtatgaaaacagtcacatagaagaatggagcagaatagaaagcctacaccaatatcgtcaaagaatcttcaataacatgcccaaaacacctaatggagacaggatagtctcttcaataaatagcgttggaattattggaggcccacatgcaaaagaatgaaattggagtgttatgctatgcacaggaataaattgaaaattgaaaaggaatttaaacataacatctgaaaccaaagaatccctagaagaaaacaggggaaatcctccataacattgaccttggcatgatattttggctatgaatcccaatgtatagacaagataaacaaaaataaacacatacaactacatcaaactaaaagattgtggcacagtaaataaataaataaataaataaataaataaaaagtcacccatggaatggtagaatgtacttgaaaacaatatatctgataatgcattaatatctaaaacatataagaaactcataatcagaaaaaaagtaacctgattaaaacatgagcaagagacctgaatagacattttttcaaaggaagatttacacacggccaacacatgaatgaagaggtgcacaaaatcactaaacatgagggaaatataaactggaatcaaaatgagatgtcacattacatctttcaaaatagctaatatcaaaaaggcaaaagataaatagtgttgacaagaatgtgtcgaaaagagaacccttatagagttttggtgggaatgtaaattggtacaaccattatggaatacagcatggacactcctcaaataattaaagatgtaccgtatgttacagaaattatacttttaggcataaaagtatatacctgtgggtgtgttggctcacacctgtaatcccagcactttgagaggtgagggaggcagattacctgaggtcaggagttcacgaccagagtcgccaacatggcaaaaccgcatctctactaaaaaacacagaaattagcccagcgtggtggttggcacctgtaatcccagctacttgggaggctgtggcagggagaattgcttgaacttgggagacagaggttgccatgagtcaagattgcatcactgcactccagcatgggcatcagagtgagactccatctcaaaaaaagggtatataccttttatatacttttccttttatatacgatagaaataaaatcactatcttgaagagatatctgcattcctgtgttcattgcagctttattcacaaaaaccaaaatatggaaacaatctaagtgttgacagatgagtaggtatgtaaattatgatatctatcatctatctgtctatttatctatctatctatctacaacggaatattattccgtatttaaaagaatgaaattctgccatttccaacaaaatgaacgagcctagaggatattatgccaagtgaaataagccaggcagagaatgaaaaatactacaggtacaacaatgaaaacttgccattataagatgaataagttatggaggtctaatgcacaacagggtaaaaatagttagtaataatgtatgctttaagttcactgagtgtagatcttaactattaccctttcccaacacatgataactatgtgaagacatgaatatgttaattagcttgattgtgaaagtccttttaaaatatacttgatgggcgcagggtgagaggagagtgagggtcaaaacactacctgctggggactatgctcactagctgggtgatgaaatcatttgtacaccaaaccccagcaacatgcaattacccacgtaacaaacctgcccatgtacctcctgaacctaaaatagaagttgagaaaagaaaaaaaaagatatcaatttcctataaggagctccaggtttgttccaaacagtagcgagacaaacagatcaaggatgaaatatataaaatagtaggcaaaacgtaaacaacatgtgtaaggcaatcgattctatataactcagcaactcctagggttcttatcaaataaaatcactgatgtgtcataacttctaaactaaaaacaacacaaatgcccattcacagtagaatgaataaataaattacttttgcttcccgcgatgaataccacacagcaattaaacaatgaactgctgctacacaaaacatagatgattctcacaaatttcaactgagtgaaacaagtcagactcaaaagattacatacagcaagtttccatttatatgaaattgaggagtagggaaatccatcgtgatagatttcatgataatgatgaccattggtgagtaactggttgagaaagtgcgagagccaggggtgtgggagctggaaatcgtccatatcttgcttgatttgggtggtggtgatagggatatatacacttataaaaattataatgctatatgcttaagatttatgtattttactatttgtaagatatatattagttgaaaaaatgcttcagtgtaaaggaaaccagtaaaaatacgctacctacaattgtagcttttgtttatcaaaaaagcatttgagtagtctattgattggtaattagcaagtttatgttaagcagccttgtcctgaatactttttagtatgtaccattaagcatttgcctttctcaactagggctaattaaaaaaaactcaaaacctcacattgtacacgttgaatatatataattttaatttgtgaattataccaccataaaactaaaaatctaattaagttgagtttgaatacattttagggaaaatacgataaagaaaattaggagcttaagaatatgcatagataaaaaataaacttgatagaaatattatttatatattatatattatgtatatttatatatatttatatataatatataaataataatatatatataaataatactatatgtatttcagaaaatcatataaaaagctgtgctaaaattttccagagagagagtaaatagttctcctgtagtggattaaaatgagattagcattggagtactagcgtaatacaacagatagagtctgaagtcagatctcaaaaatacaatatatttgctaagtaatgcgagacaagctatttaaagtttttggacctaaatatccagtctgtaagtttgttggaaaaaataaatacgctaatagagaacttaacttacagggagtgctaaattattacctgttactggaaaacataatatcagtgacattaaaagcttgagtgttgtagaacaatattttgaaatatcattttttgaagttatatacatatttatattactttaataatttgcacaacataggaaggaaagcttgctttgcacaggcaacatttttgccaaataatctttaaatcatcatgaattctcaattagattaacaataataaaattttattgtagaagactattttttcattaatatagttgtacatgcacatagggtaaatgtaatattttgttacttgcctaagctttataatgatcaaatcaaagtaaccagggtgtccataatctcaagtattatttccatatgttaagaacatttcaagtcctttagctattttggaatatacaatacattgctgtttatatgtagtcaccttactctgctatgaaatattagaacatatgtcttccaagtaattgtatgtttggacctattaacaaacttttctttattcctcccacccagagaaactttccagcctctggtatctatctataattctattctctacctccatgagatcaatatttttagttttcatgtaagaataaggatatgtgatacttgtttttctgtgcctggcttatttcacccaacacaatgacttccagttccatccatcttgctgtaaatgataaaatctcattcttttttatggacaaaaagtattctactgtgtatatatataccatgttgtttttattcattcatccattgatggacagaggttgatttcatatctttgctattgtgaatattgcaataaatatgagagtgtggttatctctttgatatactcatttatttacctttggacaaatagctagtaataaatagcttgcacctctggtctcagctacttgggagactaaagcaaggggatcacttgagcccccgaggttgaggttgcagtgagccatgatcactccactgcattctagcttggttgacagagtgagaacctctccctcctaaaaaaatccttaagaaatgtgttgatgcctggttcccttggtcagaattttcatttgatgtgttgagagtgtagcacagatgttggaatgaacctctcaagctgattttaatgtgcaaccaagtttgagaaccaccaaggaagagtttttatgaattaagattcctatactctatcctagaactaatacaactgaatctctgggaatggagtatcagaatcagatttgaaaaggtttccttagtaattctaaggactgagcagtttggatactcgtttgttagagtaaaatggttaggtacctagtatcaacataggcacccaacctgatattaataactaggaaaataaagggttggcgcctctgtgtttctttgttgaaaaatctgatactattcttagttctatgaaaacaattgaaaatttggttattatcaccttaaaagtacaaaacctatagatattgaaaatgtaattatttttctataggcatagttgaaatgattttgtaaatgttataaatcagtttctttataagcagttcatttacataaattttgttaaactgacatgattcactaattttctaaatataaatggttcagctctcagttatttttaaactaatgacctgtgttatacttactatttttaatgggcttttatgatgtttttaggtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatggaatagtgtttgcattttttgtttacctggtttaagatgtgcagcagaacataactagatgattacataatttctttttaaggcaattttataatatattttatttatgattataaaaactgcctttaaaaattcttacatggatatcaatgcagtttcactttttttattgtaatcttttttataattattttatacttgtctggcattgagttttattgggcttttggttttttggaagtagggtatttatcccaatttagaaaatttgtatccttgccataatacagtcttccatttttgtacccccaaatctttcatctgtcagaacatcactcaaaggtgaaaatatttcccacataaaattattctgttcctttaatgaaatgagtttcagctgtatataagtaggaaaacttccttttgttctatttgattcctttttacggatactttcttgaggctgtgattacacctttaccttagaggcactgcccaaaaagactcagctcttctgtaaaaatgctgttatgaatcatagcttcttaacttttacaacatagtgaggtagggaaagtaagaacactagagataggaattagaagcatggagaagtgaaccctggagcttcccaatggtgagataccaaatagttcaagaactagtaaagaagactacggaggaatagctagaagctaaatgaagaaagtatctcaaacaggaaggagtgatctgttaatgtgttaggaaagttgagttcttaggattaagcattgggtagagcaagatttgggaccttgactttgacgaacttggtggatgtcaggagtaagaggaggtattcaagagaatgttggagaggaatttaatatagtgagtattgaggacaacacttaaggagtcttgctttcaaggggatgtgagaaatgggttgttaatggagggtaatgtagtatcaaaaagctgtttattttgagatcgatgatatagtaggtttgtatgctaatgggactgattcagtagacagaaaaagcataatgcaggaaacagagggatattgctgaagccatagacctgggacacaaatagaagggttagttttaaagataggcccacaaacagctcattagtaacagcaggatgaagggcagattatggagttccagatgtttgtagtccagtagataggaggagcatgtcaaatttttgtgatattttctcagtgaaacaggaagcaagctcataaagagggaggaagtcacgaaggagtaaggaaggaaaaggagatgtaaaatgaatagataggagtgtaggaaagtaagcatactcttaggaaatctgtggtttatttaagtggtatcagtcaatgtggttctgtgtttttctccagttgagttcagcataggtgctatcactgaaaaagtacagaattcagtttaactaaaggtgagatttctctaggtgaataaaacagtcagtgatgagatgttgatacatttaagagaatgattataaaagagggatgtggaaagtagtctgggttaagtagtgaagtgagaaaataaagaaggttgagacagtggaaaatggaatgatcaattgtagattgcagtgtggttgaagatgcaatggacttcttgaggtgggaactagaaatttgggggatataaataagagaggggtgactgaaattgaaaatatgagagtataatagtatacaatattactaagtatggtatactaagtatagtagaatagtactaagtatagtagaatagtactaagtatatagtacttagtgagtataagttttaggatgtgaagaggggagtagcgtagaggcaaggtgatggaagcagatgagttcaagaaaatgagaacctaggagattgaaaccattatctaaatgaattctgaaatctcaagaagaactgtgctgagtgcttgtagtcattattttgtctttactactctgtgagaagacagcacttccttttgtgagtaatggaaagttctttaatatgtcaactgtaagatactttattacatttaattatctttagtaatgcatagtaataactaatgacctcagtaggattattcagtagatatgtgagctaaccccctgtgtcagacacctaagaggaacaactgatgtttttcaagacgaatagagggttctcatcccagggttttaagctgcaaaatatcccaccctatattttctgaaaacaaacgttatatagagtgtccacataaaagctaacaggaaatattacacacacacacacacacacacacacacacacacacagcattgaaaatgcatcaggaaagatataccctgtacccaacatgcacaaggtctaagcaatgaagaaaatctaggaaatcaaataagaccagaacatctatgactaatatataaatacttgaggcagttatatccatttaaaaggtgtcaattagacatgaaagaaaaaggccaggtgcagtggctcatgcttgtaatcccagcactttgggaggccaacgcaggcggatcaacgtgaggtcaggggtttgagaccagcttggccaacaaggtgagaccccgtctctactaaaaatacaaaaaaaattgctggttatggttgcacgtgcctgtggtcccatctacttaggaggctgaggtaggagaatcatctgaacccagaggtagagattgcagtgagctgagattgcgccattgcactccagcttgggtgatggagtaagattaaaatatatatatatacatttttacataagaaattttattttaatttttttgtaaattagaaaatagcaattaatatggtatttatataccagaatctttgaatatctaaaatttaagaagatgtgagcaatttcatgaaacttttcaaagcttagaaaaaggtagctatgtaaaataacaatgtatgttgtttatgggaacattagatgaagtaagtcatgaaaacatgcatagaaatgatcatataaacttgcaagaaattgaatgtcttgctatcaaaggaaaggatggaggtgtaagagactgaggtagaatgtgagaagctctgtatatattgtattttccttaaaaatatatatttaaactcgcatttcttgtttttcaaatgttcactctaatgaaaattcttttatttttcctgttacagtttttatttctgatctcatatatgcagtgtactgttgttcagaaatatcattgatcctccctgcaaatgaaatactctcatcctgttgaatttgagaatgtacacatgatttgctttggctttgaaatgtgagcagaaagaatgttttactttggggagttcccaattgctaaaccatgtgtcaaaatgaagtttttgtgacattacaaatggactaataagagtgcctttgttgatcctagttgaacatgagaaacttggttattgtaagccactgaaaaattttagtttcttttattactgcagaatagcctattctgtcctgattgatacagccacaacatttccttaagctctttgattttcatattgccattaggatgtagaatgccaagagaaggataaatcataggatcagagaatgttagcagtgaacgagactattggaatacattttttcaatggtttccagactttgggttctaagtaatcagtaatatttcgaaaaagtagtaaaagatatttcaatataaaaaataatgacatttaactttgaaaaaaaaaacctatcattgctaggcataatgggtctagcttgtaatcccaacaacttgggaggctgaggagggaggatcacttaaagtccaggagtttgaggctgcagtgaaccatgattgcatctccacactccagcctgggtgacatagggccacctcaacaacaaccaccaccaaagctatcattaatacattgttcctctgtctctcttcccatcctccttaccacttagtcttaaatctaatcttattaaacaatatctaaggaaaagataagaaaaatgatggttgcatctatactgaacatgtgttgacttttttcttgtcactattttctaaacaacacagtatcacaacttttgacatagcatttatgttgcattagttattataagtaatctgagatgatgtaaaggttatatgcaaatattatattttatataaaggacttgagtaattattactttaagtatccatggtggttcctggaacaaattcctcatggatatggagggaggaggaatcactgtaattaaacaaatcatcactttaaaacttaaaaccttttgcatgttgaatacagtcatgcaccacataaatgatggtggtcccattaagtttattatgccatatttttatcggaagtttcctatgtttaagtgtatttagatacacaagtacactgtgttacagttgcctatagtattcagtaaaataacatgctttacaggtttgtagtctaggagaaataggctaagccatctaggttaatgaagtccattctatgacatttgcacagtggcttaattacctaagggctttctcttcagaacctactcttgtcattaagcaatgcatgactgtagttggacaaaaaataataatgcaggcatacctttggcactgtcctaattcttaccagcatccatgattgcttaaatttgcactggaaagacttcaaaaaacagtgatatattaggacaatatatttccagtacatgacaaatgataacaacataagaactcgaaacactcaataaaaaacaaaaaataaagcaaaactagatgggaaaaggaagaagcaaatttcaagagaaaactcaaaaggccaaaaaatgtgaaatgatgttcagccttgctagtaattgggaaaaacacaaatcattttttttttttttttttttgagatggagtctccctctgtcacccacgctggagtgcattggcgtgatctgggctcactgccagctccacctaccaccttcaggccgccattcccctgcctcaggctccagagtagctgggactacaggggcccaccaccatgcctggctagttttttgtgtttttagtagagacagggtttcaccatgttagccaggatggtctccgtctcctgacctcgtgatctgcccgcctcagcttccgaaagtgctgggattacaggagtgagacacgtgcccgacccaaatcatttttaatctattagtcaaaaattagagctatgataatattaatttttggtgggagtgtggcaaaaggtactataatatactgctactagagagtaaaaattgataaattttgtaagggcaattttgcacaatatgaaaatataaaaatatgcttcatgtttaccatacatttatctagcatacagaattacccatgtgtaaacatgtatacagatgttcattataacacttcttataaaaacaaaatatttggaaataaatgttcatattaataaggcgcataccgtatgatcttagtccagttagaatattctgttttatttcaatcctttaaaagactcaacttctgactctatatagacgattaaaaaaagaatgtgttctccctttgtgcatttggtcaggtaaattaaaaaatacaccacatgctagccgcaccaaactggaataagcctttggaaagaagttgtccttgaagcttgtatctgacattgtagcaggacgagcctcagacaaaacctctcagacactgagttgtagaaggaagggctttattcagctgggagcatcggccagctactgtctcaaaatctgagctcccggagtgcacaatttctgtcctttttaagggctcacaacactaaagatttcacatgaaagggtcgtgattgatttgagcaagcaagggatacgtgacaaggactacattcactgctggtcagggagaaacagaacagggcagggagtttcacagagttcttttatacaatgtctggaatctgtgaataatatcagcttctaaatcataagttgatttttagctactgggtttaggccaatcaggcccaggcctggtttcaggcctggcgctgggctgcatgtctttggttgtacttcctggttgtttttactgaatagaaaacaatataaaacaaggagagggtctttgtctcctctcaatatcagcactggattgtagaatgtgttgctgattttgaccttgtattcaagttaactgttgcccttggtatctgtacatatctttgatttcagtctttactacacgtggcttggtcacttcatggctaaaaacatgcttgtggaagaccagtctggctcggtgagtctgtgcggccagcagtctctgatctgtacagggtattaatgtgtcagggctgagtgttctgggatttgtctagaggctggtaagggcttctggaccacttgtttctgtcctgtcagtctgtcagggttggaaagtccaagccataggacccagtttcctttcttagcttacgttatctaccagagcaccgtgggctgttacttaccttgagttggaaggggttcgcatttatacctgtaaaagtattcatccttttaatttatgtaaagtttttttgtatgccattctggatctttaaagagatgacaacaaattttggttttctactgttatgtgagaacattaggccccagcaacaggtcactgtttaaggaaaaataaaagtgctgccagaacctaagaaaaacattaatatctaaaaggtcatttagatgatttccatgagagactttttgatgttctttacctgttaggattattattgataatccttttcagattatgaataaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtgggtatgattcatagtatcaattgcggaattcactgtgcttgtaggaaatagtattctgatcttatctgtgaagcttgggcaacattttacttcacaggtaagtattctaagtaaaagagatttctgagggaaaatctatgtagtattcttggcaactttatattttgtttctgagataatctttcttcaccaagagccctccaatgtgctgttaatattttcaagagatagctgcctataccaagattcaagaatcttttatactattgattagtttctagaacattcaatgatacacagtaagacagaatttggtacttatgaagactgtttaatttgtaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggtaagtgaattctagtttcctttaaaaataacagacaggaaaatggtttctctctcttctttcttgctccttttcagcagaaaattttccgtattttatttttttaattttacttcataatttaaaactcaaaattaactgtttatttatgttcaacttttgtgaatatttgtgtgtgtgctatctactaaagaggtaagttaaagtttaaatcagaatttgcttctaaagcaaaacatcaaattttaac

SEQ ID NO: 529 - DNA, 107798 bp, Homo sapiens
gattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaacaatagccaagtgtgtttcttttcttacatatacagtaatacttatatttcattaatttttagtaaaagctctaattagtaatcaacttgtaaaattcacaaaaaaaccaatagtattaaaatcccacttaattgttgaataagtgtaagataataatagtcagcaagttgttatgctttagaagactgactttaacctatttaagctatgaactcagaaaagcatctcaaccaatatgtttgttgccattagcatcatttaccgagctgtgtacctttaatttctgccattctataatccttccaaggagtgtttttatcagttagttagggatagctggtttaatgctgattcccatgcaaagttagcccggttgtatgctttttataatatgcaagtacttctggtgttaataaggttaaaaaatagaagaaacctaaattatacaatctacagttatcagttctattgagctcactggaatcttctcctactttatagacttccttctttttcatttttttcctaattgcttagacttgttgtatatgactttttgttctttttcttattctacaatctggatatttatttagggctttcatgacaccttgtagtctgggttttcttcccaattctctacctattcattcttcttcatcttgactttacatatggaattcattagggctctcatctaggtttccttataactctcagttgttttgtttatgcttaaatgagaacatagaggccataactcagaaactgtctattcttcacctataaattgtccctgccacaaagcagattcactgtgcattggtaccacttcggctcactgcatcttgggctgcagtttctactacttaagattgagtccagtgatttagaacatacacacaaaaagttgcatgaagcaggcttattgcttatagataggcatcaagtgacacagaagcccggcgttcaggaggagccagcctcccaagactcagaccgtttgcccagggtgttgaagactcatttgcacatgccctatttgtaccacagctgagggacccttgaaagaagcctgccccgtgttttataacccaggcatcccatgatacactgggctaaagcacttaaggaaatgttctaagaggcacagtaagagagtctgagacttatctcaggatgttgcattcccagctcattctacagctattcttgagatgcacaagttatagaggaggaaaacctgggttgctccaaggccacttggagagttgtcctgcatttcctctagcattttccttttttttctcctattacaataaagaaagtacatgtcattctaagaaaggccattttctctgcttaagttaatgataccattccatttttatcttttggaggactttagattatcctccctcttttgatttagcagtctttccctttcttctgcattagtcatcctagattacatgtattacagtcttccaattaaaaacatcaatgaccatcctcagatattcttctgggtatattactttgctcatttccttgctccctctcctaattaaacatctctttttatcacactgtctccacatcctcagcctccgtcattattcatctctctactgtccagttttcaccattatcacttcattcagtctgctcttgtcaacatcatgagtgacatttatgttaccagtccaatatatttctctgtcctcaccttaaaccacttcatagcagtattaatgatggtgggtcactttctctttctatcttccttttttcgtgttattctactctcctggttgccttctgtctcattgattgctctgtttcaggtttttgtttttttttttatcttattcttaggtggatcatcttattctgttccacctaagtcctaacttttatctatttctcttctttatcttctcttctctaggtgattggaatcatttccatggattttaaacaaatattttctgtggacacctaggtatcttcaattcagaacttggacttcagcctcatacttccatcagatgcttgttatcaccacttccatgttccacagacatctcataattaacatatttaaaatggaaccctcattttttttccttgcataaaccttttactacattattttcttactgcttagaaacccaggatattttctgatttatctctcttagctcaacaactttatctcttcatataaaccttagcatgaactattaattgtatcttcaaaatatctcttcatttattgcacttcttttgtatcttctatcacccctttatccagctcacaattatctgttctctgcattccaaaacaactctgcaactggtctcctatttccattattttactgtctccctttattttactaaagaccacaacattatattcatacaatttaaatccaattaaaatgttaatgcttaaaactcttaaatttttattgcattcagaataattctaaccactcatggtagcctacaaaatcacaccttatcagacatgaacctcagttctattcttttcccttgacaatcccatagccttaggtattctggtctttcgtcattttattaaatatgccatgtatttttattttatgttgtggactttttgtatgtgtttctccactcttttggaatcctcttaactgagttcttagcatggttggctcctgtttttataagtactcccaaacacaggaactagcattaccattttttcagtcctgcagttcagaaatctggggcttacgtttgaaaccctcttctcttacatttcccagaacaaataaagcactgaatactttagatttttgcattctatttcttcactatattattttctctttctacttctactatctagtaacccttttcttcaatgaccaaaatctattttacttccagcaatatggtgaaaagactatcgactcttaatttaaagccagactttattgtttataacaaatgcattgcagaatgtaaacagagaatgtaatcacaagccaggggctgggagcacttcatattagtttcttaacatgtcagaaccacattctttcatttttataagagagtaaccagagagccactttaagaatttttagtggttagcagaggagtagaggagagtgcccttgatacacaggtagtggtgaacatgtatctttacccccagcaggagagaaaagataaacattagagacataagctagcaagcttcaaaaaggatatttgaaaggggttttgtaatgggatatcagtttttgtacaagggaatttatttgtacaagaggttacggagcttttctcggagaataaaacaagcctgtctattacttgaaattttaacttttagaatagcttacgtgcacttatgctgattattgaggggttgactgcagcatcagcgtccacttcagtcctttctccaaccattccattatctaccatgcgatcagagtgatcttttcaaatcagataaccaccaccacttaccttaggataaaaagccaaaattcttatcagggcttgtaaccctgtgcttgaagtcttacctcactcaattctcctctttaatttctgatctctaaccatgctaatcttttagttactgcaactcaacaagatctttttagttctttaatttcaattcaagagacattctgctctttctgcttggaatgctcttttcttacctcttctcctaattaactcctgttcatcattcaaatcttaattcaaatgctgatcctgcatgaatatttattcagtattaggtcaagtcccctgatgactgttagcaatctctgtacttcttatcactcagcatagtactgtgggaaatatctgcattgttctttattgaatccttagtctcaggacattatccagaatgtcttacgaagagatcaataattatttgtaaaatgaattgagataataataaaagagaaaaataagagaaaaaatgtatctatttttgagaaggagaacatttttaatgaagatgtggccctggaatacagatgtttctctcatttttttcctatttcttcccaaatttaattaatttctggttaaccctgatttctcagatcataaaaatcatggggaaatcaactactttggcaataacccatcatgttttcaggatttgtaagccataacaacagtaaattctttggtgagctatactctcagtaagtaaatgaagaataattcaaatattattgggaaaatgatgccacattcatctgaatataataaatgtgaaattcattttactatgttcttagaactttgtaatactaatttataatagcagtttcatcctttagatatttcattttatctacggatctaattcttcctgtgaaattactgagctatttctctattcttagaagagaaaataactctttgtgataaaaatcattactatgtataattagacttccgtttacaagtcaaactgaaccaacgaacttacaatcatagaatgtgactagtcacagggaatggttggggcattagctcagtacctgtccaaagtgagctcattattatgattattagtatcaccattatcaatcagcttccacataaagtgtacctaaatgctagatctatatgatagcttccaaaatgacactgatttttaataatccaaatctttaaagagatcactttccattttagaaaaatgagatttttttttttttggaaaagatagaaaaacctctaagcattttaaccaagggttttagaacactttatttttatgaatatatcaaagcaaattccttctttattttgaaagtgactggaaacaatttcacggtcttactaagggctagtttaagtgagtctcaatttttcttctgttttgtttgctcttacaactttcctcacacacacacacacacaaagggagatataaaaaaatctagatataacagatgcaacttacaattttttggtaagaaatcataaagttttagaaaaaatcatttaggagtgtcaataaaaacgatatttaagaaaacagtaggaaaagtgatatattaaaagacttttaaacacctttcacaagaaattgaacagatgtgcaaatacacattatacgttatctatttgctcattttatcctgtccttaaacataaactttgaagataaaagaaagaagtgtggctcagggtcactcatgtaatctgtttttaggcagaaacaggtgtgttgaaaggtttttaggtaaaacaaccaccacttagacttcaataaagtagtatttattattttcctataattgcaaatttaccaaatgtaactcactattttttctttaatattttcaaagatatttttgagtaattattatattttcacaatcaattcagtagacatttttgaaaaacttatctgaacctagttttctcatctgtgaaatggaaacaatatatactctctcagtttgttgtgtcaaatgagaaaccatatatgatatactaaccactggttctggctaaatgcatacctcctcatcttttcagtaaagacatgactgttggccaggcacggtggctcacgcctgtcataccagcattttgggaggctgaggcgggcgaatcacttgatgtcaggagttcaagaccagccggaccaacatggcaataccccatctctgctaaaaatactaaaattagccgggagtggtggtgcatgctggtagtcccagtcccagctactcgggaggctgaggcaggagaatggcttgaatggcgctgggagattgcagtgagccaagatcatgccactgcactccagccttggcaacagagtaagactccatcccaaaaaaaaaaaaaaaaaaaaaaaagtaactgttattctcagtactttgggccagcacagtactgatactctcctaaaatctaactcaaagagaaaaatcacaaagcattggaattggagcagaaagtaatgtattcttgtttgacatctttccacattcagtctgtgtactgttagctgaaagctagttgacacaaaatgctgtcttaactttagtgttgtttctaatttagttctaggtcataaaatttgtaggaaagtctaattccaaaactttatcaacagctttgttacgctcaggtattatgatcagatatcttatgtgtgctctatgacctcaagcaaagattaaataaatctgtacattacagtgaagacccacatcaaccaatgcaacatacatttatttttcgcagcactcttttaggtgctttgaaacatgtaacccatgtttaagtgcagaggatagctggcaaggcaaaatataactatatgatgtgttaataagaatacagaggaatagttaaagtgatgcataataaagtacggaaatatgttgtttgatttcaaaggaaggggatagtacatatgctgaaatggcctgggaaagcttaatgataaggaaggtcttgagatgggtaagagagatttgtaaggaagagaaaggagggaaatttattccaaaagaagaaaaagtatgacaaaagcacaaaggaataaatgagatgaatggcagaaaatagatcagttaatcagtgaggctagagaagcacgtttatggaacactagtgaaaaatatgatgaaaaggtagaatgtgaccaataacagaaggatccattttctatcaagactttcttattagatttgatatgttcataccagcaatgtcatctctgaatataaaagatatctgtacttacgcaacataattatatgttatcactgggaaattctaggaagtaattatcagtccctttattaatattactatagaattaacttattcagttatagggtacactacgtttatagtttacttccttcctcccccagcctccagctttgtaatttaaatgaaactaaattccatcataattcactcactaacacataggactgccaacctctgaatggctttagatttgcgtgaacctgtatttgtcaatgcttgctccaggattctattggcatatgtcgaaataattgatttttatgacaacctgcttcctgcttactgttttttaccatagggagggaaaaaatagaattatcccttgatttagctgtcagtcaaatgacaactcaagcatgctataaaattaaagaaagccccacattctaccaggaactgatgattttagtgatactgctctctttgtagaagaaataaagtattttcatatcttatgatgaatatcactataatacattaaaatatagaattgcatccagcaaaatatcctgaagtggacaaaatatgcccctccaaaatatgccatttttgcacaataatttttttgagcagaaagcaattagctcactgactttcacctttctaaaagcaagacataaatttcaatttgtaaagacgtctccctttagtgtacttgtaagaaaactactccatagacaactcttaatagctgatgacttatctgcataagaaactttattaaacaatcctgatttagaatacatttcttcccccactttcccgtaacttacctcctgcaccgagcagccctaaacttcttttctttggctagtctaagatatacaccccaaatcctaattgcctctttgcatcacatttctttgtgaatttccatgtgtatgtacataattaattgttatttttcttgttaacttgtctgtgatcagtttaatttgtagggtcccagacactgaacctaggatggaagagaaaaagtgtttctgctttcctatggcttaggcaaccatgaatggacaggcagggcatcccacttgctccagaggctgcagctcaattgagatctgacaaagctgatgtgaaaactttactgaaccagatcctggaattttgcctacaaaaatacaaatacagaactctgttttttcttttccaaattcagatttgcacgagaataaaattataagaattagttctttggaatgtgattctggtgaattttctcctgagtatcattggttattgaccctttcactcccagggagagccattgctttcctgtgtgtctcattttgtgtcttgagcgcttggattcactttcttcctggtggcagggtccacattgttgggcttgctgtacaggcagtcagtcatcagattgtatgccctgagaatttgtagatggtcagatagagatgcaggttgcactgtcttgctactgatgttctaccaaccctctcagagggtttgtctaaatttttatttcttttggctattgctgggaggaactccatatcataaggacttcatttttgcactctctttgtggatacctcttacgttcttggctatctacattattaaatatgttttttccctctcttattaatcttttatttatttaaaagtggtgggttcccatggccttgggcatctctgcctctgtggcttcacagggtatagcctcatcctagctgctttccccggctggtgttgagtgtctgcagcttttccaggtgcagggacaagctgtcggggaatctaccattctgggatctggaggaaggtggccctcttctcacagctccactaggtggtgccccagcagggatcctgtgtgtgtgctctgaccccatatttcccttctttactgacctatgagagtttctccatgaaggccccgccactgcagcaaacttctgcctggacatctgggtgtttccatatgtcctgtgaaatctagggggaggttcccaaacctcaattcttgacttttgtgcacctccagctcaataatacatggaaaatgccaaggactggggctaccaccctctgaggcaatagcctgagctgttccatggccccttttagccatggctgaaggggctgggatgaggagcaccaagttactaggctgcacacagctcaggggtcctatgcccagccgaagaaatcactttttcctcccaggcctctgggcctgtgataggagagtcggctgtgaagacccctgacatgccctggagacattttccccattgcctttgagtttaacatttggctcctcgttacttattcagagttctgcagctggcttgaatttcttctcagaaaaagagatttgccttttcaatcatatcaggctgcacattttccaaactcttatgctctgtttcccattttaaaactgaatgctttaacaatattcaagttacctcttgaatgctttgctgcttagaaacttcttctgccagatacactaaatcatctccctcaagttcaacagttcacaaatctctagggtaggggcaaaatgccactagtctctttgctaaaacataagaagagtcacctttgctccagttcccaacaagttcctcatctttatctgagaccacctcagcctggattttatatcattattgacattttactcaaagccattaacaagtctctagggagttccaaaccttcccacactttcctgtattcttctgagacctccaaactgttccagtctctgtctgttacagagtcccaaagtcacttacacatttttgtgtatcgttttagcagcacttcactcctggtaccaatttaccgtattagtccattttcttgccgctgataaagacatacccaagactgggaaatttagaagagaaagagatttattggatttacagttccacgtgcctggggaggcctcacaattatggcagaaggtaaaaggcatgtctcacagggcagtagacaggagaacagagcttgtgcagagaacatccccttttttaaaccatcagatcttgtgagattattaactaccccgagaacagaacagcatgggaaaacctgccaccatggttcaattatctcccattgggtccctcccacaacatgttgaaattaaaattgggatttgggtggggacacagccaaaccacatcattggggatggaactttttattgtgagtatgtctgcacaagttacctgtgtagattttcttgtctgtgtggctgtgggaatgtcttagtcaaacacccctatgcaagtttacttatctatgactatagtttgattttttaggctgttcttttgtttgaatgaattcaactgagtacccaccctaactgcctgcctgactggtttgtttatttctcctctctcatttttacccacgggagtggagagcctaactgctgttagcgaggtggggtgatgctcgctacttcctgctggaaaggggcattgtatggggaacagcagctagggttccttctgtgagctttctaagggtccttggaagaaatttgtgtccatgcatggtttcatttgcatcaacatttgtagtttgatagactttaggcaagaaaaaaaaatggattattagaggacatgtataaaaatgaaacaaggggataggtaatgaaagctcaaaaatctcaaggcttcagccatgcccagataaatagtggctatagttatgcctactaagatttgggtgcatggggctttgctttggtgaacttccttggttttattttcccaaacaaagaaacctctgggttatgggtaccctgtatactcccataacctggtaggatttgcaggataatagcccaaaactagaatattgattcagatttttacactacttattccttttttattttgagttgcagccagagattgctggtttgtttacaggaataagcagagttattctaaaatgtacgtgatatggtttggctttgtccccacccaagtctcttctcgaattgtagctcccataattcccatgtgttgtgggagggatctgtgcgagataattgaatcatgatgggtgtttttccccatactgttctcatggtagtgaataagtctcaggagatctgatggtattataggaggaaatccctttcatttggttttcatcctctttcttgtctacttccaagtttttgccttccatcatgattgtgaggcctccctaaccatgtgaaattgtgagtccattaaacatcctttttaaaataaattacccagtgtcagatgtgtctttgctagaagcatgagaacagactaatagagtaggcaaaacttaaaaacaactaatgagattagaatttaatgacaagtgtatgataagttttgaatcaaattttgctctctccagtcctcatttttgttcaaaacaaatcatgatagtcattttgttaaaaacaaattacgactgagttgtttgcaatgtaaacttaggctcatacttggcttgattatttgcataatgtgcagcaaaaataattatttttgcagtcttttaaaataagctttgatggaactctgttccacaagagatctcagataggacttttttaaagccaagcccggccatgagtttgtaccctcaaatacctatgagttgagtgaattcctctcttcttaatgtcacaagaatatgtggttcctgggactgttatatagtgacattctttactcatcacagattagaaaccccgtacacagattatgtagacaaggtaggaggccacatttcccaatgggcttttattggctctgtaagtgaagcttgattcctcaaagagaagcatatccatccaatcaaagccttggtaaaacaaccagtttctccaattgtgtcatgttgcaaaagaaaatgaattcttactgcactggtgcaaacaacgatattgccataagtttagaatattcccaaatagtttccaaattctggagtaacttggcagagagaaacaaatacgctccaaattttgttcactggtgtataccttacttaattcttaaaagctgtagatagcttaaaagaaaggtttccttaactctgaagaacaaaacaaagaacagcaatgttttaagcaaaaagtaaaaaaagattatttcagacttctattagtttagttcatgcagttaactcctgtctgatattcataaacagttaagatcttcatgactcttgtatgatttcttttattctcatgtcatgatttccaaagttatcagaaacctgcatttgagagcacattgtaaagtcctacagctgattgtaaaacatcttttgaagaggattaaaacaagacaacatttatctgtagatgacatagtgttcaggttagttacagtgaaaaacatgactggcaaagatatttggttatttctgtggtttgcaataacttaatacaataatcctaattatgatccatagcatattctcaagcattagaatttttaaaatcccatacaattttggaacatatattaatattatcactaaaatataacctgaataaggttaaacataattttgtcaatcccacttacatgaacctgtcaaaaaattctgtttacttctcttctggatgcttcagggccctctgtagcatacaaaaggtagggttcaggagagacaattttgaatgtgaagtttgattttgggaagcctgtcaaatgttacaggtttaaaacacttgatagtgtgaaatacaattccaggtaacacataagttatttattttggcaaaaggatgactcagaaattttaaaactaggcaacatcctttactccttaagagggaggacttcgctttccaaacagtttgtctcctgtctactcttttctctctttggcagtctcccaacaaggcaaacaaaatatttcattattcttctctattacatgaaaaatctgtacaagggaaagaaagccaaattttacccttacattggtttcaaaataatcctttttcattggcaaggtttatattttatgcctttttataatcttttatgacaaacacattttactgttcttacacaccttgcaggtaaatttatttttagttgtcttatttacatgttttaatggtaaatcttaccaattttaacgttaatataaaacctggtaagttgttttaattatgtactagatgcagataaagtctgatttttccatcatatttaggggcatggttaatttcatatgtccccaggccttaccaagttgtaaggtaggtagcatacaaccttgaaacatttagcaaacctggtatctaacttacatgatttaaactttctatttacattttgatgacatttgcattgtaccaatttcatctttaaaacaattactatttcttagaggttaaagtcccataaactaaaaggcattagagttttaactttcctctaaaatatttgatttaagtgcttatttttatttaaggcaatcaattagagctcattagagacatcacacacaacacatatatcactacacaggcaaacagaagaagatccagtagttctaagatttttttcttgtcccatttcctaattgaattattagctttccagtggagccctttaagagcaaggatagaaaaccatgaagtttctagggcctaatcaacttgtatagctgtaagacaaaagcagattttgagtggaatctatctatgagcctctaaattctggtattccatgaggaaaacagaggtttctcccaaaatggaacccatcatgccttttctgtttttcccaagaagtatcaggccagcaaaagttatcttgggttcattaagagtggaaagacagagtggagaaaacttattcagtcaaaacaaaagttatcttgggttcattaagagtggaaagacagagtggagaaaacttattcagtcaacacaaaagttcttttcaagaaaaacacaatccaagaagagaaaaacataaaggccttttaaatatacctataacatgaatatccacttttaatcaagctgagcattctttaagaaaatcatttgaaatatgctgttacctgactttagctaaatcaagcaggtaatatttctggcttttgactttaccaaaagtaatatcaaaggtgaaacaacaactctcaattaggttataagttaaccacgagtatacaagatatcttataagtggtggtaagcagcttttaccagatctagaacctttaaagtcaattcagagaaaagaagatttcagaaaggaagttagagttgttcatggaggaggaagagaagattaaaagtcacacagctattaacttgtaagtattcattacccaaaccaggagcgaacccgggccaccattataaaaaggcaatggctaaaaagaagtactgccacattgttacaggttatggtcaaggacataaaacaagatggagacttgcagcaaagtttgttactaaccagtttacaggggtgacttgaacagtgagcttacggagtcccaggcctggattccgttccaaggtaccctctctctgattgtttcttgtattttctctcctttttctgagactcctcctagtacctgttatgaaagactggggtggctactcttagaaggttttttaaggtgccatctggttctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagggttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatttcttccaggcagaagctagaaagagaggtttgaggtttaacagactgtcactatatatgcctcccagctgtagaaaattaacttgtctcattaataaactgttcaaattcatttagcagtggtgagcttttacatgaaggaaaagcaactaaaatggagagggatgagggtattcactcgggatgaaatatcttttcatagagtaccatgaatgactgttattgtgggacaaaaagcacttactgggtgaaggtttagactgaaatcttgaaatcccctggtattttgagtttctgcttagcctttccaaaggaataaaatcagatatgtatctatctcagtgagcagaggagtgactttgagtagaatgggaggaaggtttgtcctaggcagtttcccgcttgaattttccctagtgatttcaggggcccagtatattgtcctttcacacatctgacaagtaattgataaccagaatatctaagcagctcaaacaattctagaggaaacatatctaatagttggatcaaaaagtgggcaaaagatttaaatagacatttctcaaaagcagacagacatatggcaaacaagcaaatgaaaatgtgctcaacatcatcgatcagagaaatacaaataataactacaatgagatattatctcaccccagttaaaatggcttttatataaagacaggcaataaggattgctggtgaggatgtggagtaaagtgaaccatcatacactttttatggttatgtaaattagtacagctgctatggaaaacagtttggaggttcatcaaaaaactaaaaatagagctatgatgtgatccagcaatctcacagctaggtatatacccaaaagtaagaaaatcagtatattgaaatgatatctgcactcccatgtttattccagccctgttcacaatagctaagacttggaaacaacctaaatatccatcaacagatgaatggataaagaaaatgtggtacatacatacaatggagtactattcagctataaaaaaaaatgagatcctgtcatttgcaacaacatagatggaactgtacattattatgtgaagtaaaataagccaggcccagaaagacaaacatcacatgttctcatttatttgtgggagctagaaatacaaacagtggaactcatggtcataaagagtagaaagatggttactagaggctgagaagggtggatgggaagcaagtgggaatgttcaatgggtatagaaaacagaagaatgaaaaagacctagtatttgacagcacaacagggtgactatagtcaataacaacttaattgtgcattttaaaataaataaaagaatataattggattgtaacataaaggataaatgcttgtggtgatggataacccatttaccctaatgttattattacacattgtctgcctgtatcaaaatatgacacatgccctgtaagtttatacacctgcaatgtaccaacaacaattaaaaatttaaaaaggtgtatccttcccagtgaaccaaaatattttacattgataacttttaagttatcatagtgtgttggaataatcacagctttggaaagaaaaaaattatagatataaactttcaaagatggcaggagatatagatctctctttagtggattaaaatatgccatttgttattaacatcacactgagattttttaacacaggacatcttctggaaatgatatgattataggagttataggaaaaagcgttttttcatactgtgattacctatgctatgaagaaaggagatatttcctctatgatgtctaatttagcataattattgtttttaaactatatttagatttaattaagagatacacaaacaaattacttttagtagtaagaagatttttaaaaattttttgtgtaagatgactatgtagtaaagaaggttacaaacttactttttaacgtagaaaaataatctcaccttcttgccccatggaaaattgaaatgttatgtggaacccagtgtagaaaaactctcagtgaggttttctgtcttaagtttcagtggattgaggtgagatcaacgcctgttccacctttttcctccctgtcctagcaggcttgaaaacatttatacagccataaaatgttgcctttaaattcaagtatagaaaataaaatttaaaatgtgatatttttatatattttattttaatatcttacatgggaaatgtttttgaaatgttaaaaaattaaaatttttaaaagagtactgtgaaataatctaatcacatgtggaaattttgttactatttccccaagcatttttggtacatttaatgagttgaatgtaactcataagtagataaaaatgtttaatatttaattttctgctgcaataatgttacaaaacaaccttaaattctcagtaacgttaaacaacatatttttttctcccaaatttccaggttatttaagggcagttctgcttcatattgcagtttgcctgggctttactccaggctgtgtgttggagttaggtctaatatattgtatccctacgtatcccagttagaaagcctaacagatttctttgtacttcagtcagctcgattgtatttgtcattcaaaagccaaagcatttatcctaacaccaattgcttcttttttttttttagatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtaagccactgcacccagcctaactgactgcttcttttgttctgtagtctttctccaaaactgtttttctctgtactcactttcaccttctctcacacatatatgtccctcatgtccctttatgtctccagggtcttctatttccacgtaatcttaattgttcatcatatcctggactcatgagtaattaatctgttattctccctgaaagtgcagccttgttgaatagaatgtgttctttaaagagcagctttgtttctcgagtgaggtattaacttccagatttaagtgaaaatgagttccaagttttatgtttcattgtgtgtctaagactgacaccgtttattactgtggcacttacagcttgctttcaatgcctccaaattctctatctgaagggctgggtaccatatctcatgtctgaacatattcctcagaatcatgcagtaccagctatgttccttctttatattatggctcctgaggtgcctgttaagcagccaggtgaaattgccttttaatcagtataggaacagtctctttcctgctgatgctaatgctttttgtaaaaaggtcatgctgtattgaagttcttctttcacggcaaaaccactaatggaactcatctacttactgatgggtggaagctctttgtatgccaaagtcttgttttgtttgtgaagaatctctttccctcaacagtgatgtgctacgttaggtctcaaatcattgttgctttttaatccaaatttatgacaaagattttcagtttgtatgcataatttccttctctggccttaaccatcagtctgtggacttgccaagcaacaaccacaagaacaacaagtctgaggtcaagagacactatttagatctcagaatcatttgttgtcctttatcctttgacaaagttttgcctttctttctttatgagattttttccctaatggtttctcaatctcttgagaagaagaaagttcttgactcttgcagtctttctcattagttgaattataccatcagtacagcttctgatcatgtcgagaaatccaccatgaagaaataaaacatttccgattacatggattacgtttcttggattcttataggcattaaacttcattctaggatacaacctcatgatcttgtcttattctcagaacaagaaatatattactatatacattacaatatatatatattgcagtttccttgctatatatatatatatatgtatgtattatagtaaaccctgtaggcaagcaggaacacttcagaagtctcaatgaatccatcattagctgttagtaatgacaacactgttagaattatttcaataatcacacattgttatggtctgaatgtgcacccccaaatgtaatatgttgaaattttaacacctgagggcatagtattaggaacttgggagtggaactctttttagtgctattatgaataagatgcttgccttttccagcaaatgaggacacagccacaagctgccctctaggaactatgaagttagtcttcaccagacacaaaatctgcttgattttgaatttagcctcccgaactgtggaaaataaatttctgcttttataagccactcaatttatggtatttggttattgtatcccaaacagactaaaacacacattatttacctcctttttggactgtctggggttgttgctttaaacttgcttcagtgcctagaactgctccaagctccctgtcctctggcacacacgtataaataattctgctggaaaccgacatgtttcactcagtcatccaaatgtatttataatgttgtccaaatatatagcacttgttacaatgtttacattttagacatattttgagatatgtgccttaacagagtgctgtgattattattaatatttagtaacttatcttaccagacctaaactcaaagtttttcacaatggcaatgccttatttgggacttatttgggactgaatgtatgaagatcttacattgagtccaaattgatttctctgttagtctcgcaataacattaaagccacagaattatctgctgtatatttcttgtcttgttgtagctgatattctacatattaggacaattaggacattagtaatatctattaaccttagaataaaatgtcatattgaaattgaagaggaatattggaactttgctaagaaagaatgcttttcacacacaatgatatctaaaatggagcctctgttcctggaggtatattttacaaaaattcagtgttactataggaattctgtacacttctttcttagacatttgtattccatcagtgtcagtcctctctgtattttaaactaaataggatttctttttccatctttctgtttgacaagtattgttttgctgaaaatttgctattcatgttcttttaactcattagaaagaatatttagggtctttagtgacaaatgacatggtataaatgaaaagaaaacactgacattgtaattgagaaatactaattaattaggagaatattatttaaaaacattgtttaaatatttctttgttttattattattatactttaagttttaggttacatgtgcacaatgtgcaggttagtacatatgtatacatgtgccatgctggtgtgctgcacccattaactcatcatttagcattaggtatatctcctaatgctaaaccctcccccctcccccaaccccacaacagtccccagagtgtgatgttccccttcctgtgtccatgtgttctcattgttcaattcccatctatgagtgagaatatgtggtgtttggttttttgtccttgtgatagtttactgagaatgatgatttccagtttcatccatgtccctacaaaggacatgaactcatccttttatatggctgcatagtattccatggtgtatatgtgccacattttcttaatccagtctaccattgatggacatttgggttggttccaagtctttgctattgtgaatagtgccgcaataaacatacgtgtgcatgtgtctttatagcagcatgatttatagtcctttgagtacatagccagtaatgggatggctgggtcaaatggtatttctagttctagatccctgatgaattgccacactgacttccacaatggttgaactagtttacagtcccaccaacagtgtaaaagtgttcctatttctccacatcctctccagcctacaatgaactcaaacaaatttacaagaaataaacaaacaaccccatcaaaaagtgggcaaaggatatgaacagacacttctcaaaagaagacatttatgcagccaaaagacacatgaaaaaatgctcatcatcactggccatcagagaaatgcaaaacattgtttaaatatttctatcacaaattgacagcagtacaatgcacaccaccagcaatgtataattctagatatgagaggtaaaaagataaaacaggtattgcattttctccagaaaacttatcatttagtggaaactggccaataatttcttaggccttaggataattttacctttgattctctagttaatccaaaatatataaaaatattaaccaaaagtatatatttttaaaatgcctacataatctaatgcagtattttttgctctcttcttgaagtgaattaaattccttatcactgaccataaaattgaactccattgatgattcttatttaaaatagttaaaagtgaatgtaaagatcagttgtggttttccttttcttacccttgtttttacacttatatttgcctgtgtcattcacacacttttagaattcaaaacaataactagaaatgtaatcatttgcttttcaaaagcttttcgcatctttccaaagttaatataaagtcttacaaaacttttagctaattcacaaaaaaatcaaacatatatagttgaagcaattttttttttttggtagatttcttcaaaccacagaaatttcagttatggcatggtaggtcttttgaaatgtttcattttttgtatttgaagatgcagagcaaaagtatttccactccaactcccctttaataaaaattgaatgtaacaaaaaaatcaaaatctataggaaaataaccccttcatctatgttaaaactatgagatttccagcccaaataagttataagaaccagtatagagtccaggctcggtggctcacgtctgtaatcccggcactttcggaggctgaggccggaggatcatgagttcaggagatccagaccatcctggctaacatggtgaaaccctgtctctactaaaaatacaaaacaaattagccaggcatggtggtgggtgcctgtagtcccagctactcaggaggctgaggcaggagaatggcccatacctgggaggcggagtttgcagtgagtggagattgcaccactgcactccagcctgggagatagagtgacactccatctcacaaaaaaaaaaaaaaaaaaaaaaaaaaaaaaggaccagtatagaaatactaatacagtaaaaggtggacttatatataaagaaaataaccaacagattttgtctatggcacaaacttcttagaaattttgaggtctttagccttaaagacctaatcaaatatttattactttgaacagtgagctactgggatatgctgggctttgagcctatgtacaaatctaattttagaagtcaggacgtgttgtaagcaatagcaaagaatatgctagatgatcagcttggcaattgttgaacaaacttcattcagcagtgtgaggacgtaattaaagcagttgaccttcaatctattcactctctttattggcaaatggccgaggaataagactagaaggaagatgaactggtttagtctctttgtcagctgaacttgtggtgaaagagactactgatattttctaggatgaagagatcttatctctgaaataccctttgcaggttgctcctgactgaaacaaattcacagattctttcttctcgctcaattttgctgttgattcttcattttacattctttatttcatttattttatgctttagctctagaattttagtttgggttctattttttcaatctgtctgtggaacttctcaattggtttgtgttttgttttttttcaagttttggttgaattgcctatttattctcttgtaactaattactctcctttaaaacaattatttgacatgaaaaaccttgcaaaaatacaaaaatctataaacttcttgacaaagaattcaaaataattattttaaagaatttctgaatttgcagcaaaagtttgctatagagcaacatgaaagcacagaaaagtatgaaactcattgattaaggtaaatatataaaaaatacagaacactctaatagtgtagtagtggtgtgtaaatcagttttattgctagtatgaagcttaaaatccaaaataataataattatagctacaataatttgttaatagatatagaatattaaaaatatataatgtgacaccaaatatataaaatatagtgggctgagtaaaagtatagagttttgaatatgatcaaacctcagtttaaaatagtttgctccaactacaagatagtatgtataagcttcatgctattcggaaagcaaaaacctatagtagatacccaaaagacaaagagaaatcaaagcatgtcactacagaaaatcataaaatctcaaagaacgacagcaagggagaaataaaggaacaaaaatatgttaaaaggctgaaaagcaatgaacaaaatgtcaattgtatgttcttatctatcaataattaccttgaagataaattcattctattctacattcaaaagccagagtggctgaatggattacaaaaggagacccaacaatatactgcctacaagagactcacttcagcttcaaggacacatatggtgtgaatttaggggatgagaaaatttgatattccatgcaaattaaaacaaaaaaacaacatggataactatccttatatcaggcaaaatataccttaagataaaactctaacaggtgataaagatggtcactatataatgataaagggatgagttgattaaagggatgaaacaattataaataaatatgcacttaacattagagcacttgaaaatgtaaagcaaacattaatatctggagggagagatacagagcaatcaataatactacagatataggtaaccttattgacactgttgaaattatcaatactccaattacaacaatggatagatcatttagacagacaatctgtaaggaaaaaaaaattagacttgatctgcactttagaccaaacggacctaacagatgtatgttcacatttcatccacagccggagaacaggtgttcttttcaagctaacaagaaacatcctctaaaatagagcatacttgaagtcacaaaatgtcttaatacatttaagaagattgaaattttatcaagtatctcttttgaccacaatggtatacaactagaaatcaattaacaggaggaaaactggaaaattcaaaaagaagtgaacataacacaattcttaaaaactggtggtttaaaaaggaaataaaaaggaaaataaagaaatcttgatacaaaaatgaaaacacaatacaccaaagcttgtgggatgcagtaagacagtgctaagatgaaaatttgaaatgacaaacacctacattaaaaaaaacacaaatatttcaaataaacaatctatcattaaacctcaaggaactagaaaaaaagaagagcaaactaagcccaaagttaatagaagaaagaaaataagaaagatcaaagcaaaatagagaaatagagagtagaaaagtaatagaaattgaaagacattctgtgttcatcaatgtgagaaattaatattgtcaaaatgctattacacaaagcaatctacagattcaatgtaatccctatcaaaagtccaatggcatttttccagaaacagaaataaatcctaaaatttgtatgaaattacaaaagactataattacccaaactgatcttgagcaagacgaacaaagtaggaggtaccacacttctcactttcaagttatattactaaactacagtaatatatatatatatatatgatactggtatgaaaacagtcacatagaagaatggagcagaatagaaagcctacaccaatatcgtcaaagaatcttcaataacatgcccaaaacacctaatggagacaggatagtctcttcaataaatagcgttggaattattggaggcccacatgcaaaagaatgaaattggagtgttatgctatgcacaggaataaattgaaaattgaaaaggaatttaaacataacatctgaaaccaaagaatccctagaagaaaacaggggaaatcctccataacattgaccttggcatgatattttggctatgaatcccaatgtatagacaagataaacaaaaataaacacatacaactacatcaaactaaaagattgtggcacagtaaataaataaataaataaataaataaataaaaagtcacccatggaatggtagaatgtacttgaaaacaatatatctgataatgcattaatatctaaaacatataagaaactcataatcagaaaaaaagtaacctgattaaaacatgagcaagagacctgaatagacattttttcaaaggaagatttacacacggccaacacatgaatgaagaggtgcacaaaatcactaaacatgagggaaatataaactggaatcaaaatgagatgtcacattacatctttcaaaatagctaatatcaaaaaggcaaaagataaatagtgttgacaagaatgtgtcgaaaagagaacccttatagagttttggtgggaatgtaaattggtacaaccattatggaatacagcatggacactcctcaaataattaaagatgtaccgtatgttacagaaattatacttttaggcataaaagtatatacctgtgggtgtgttggctcacacctgtaatcccagcactttgagaggtgagggaggcagattacctgaggtcaggagttcacgaccagagtcgccaacatggcaaaaccgcatctctactaaaaaacacagaaattagcccagcgtggtggttggcacctgtaatcccagctacttgggaggctgtggcagggagaattgcttgaacttgggagacagaggttgccatgagtcaagattgcatcactgcactccagcatgggcatcagagtgagactccatctcaaaaaaagggtatataccttttatatacttttccttttatatacgatagaaataaaatcactatcttgaagagatatctgcattcctgtgttcattgcagctttattcacaaaaaccaaaatatggaaacaatctaagtgttgacagatgagtaggtatgtaaattatgatatctatcatctatctgtctatttatctatctatctatctacaacggaatattattccgtatttaaaagaatgaaattctgccatttccaacaaaatgaacgagcctagaggatattatgccaagtgaaataagccaggcagagaatgaaaaatactacaggtacaacaatgaaaacttgccattataagatgaataagttatggaggtctaatgcacaacagggtaaaaatagttagtaataatgtatgctttaagttcactgagtgtagatcttaactattaccctttcccaacacatgataactatgtgaagacatgaatatgttaattagcttgattgtgaaagtccttttaaaatatacttgatgggcgcagggtgagaggagagtgagggtcaaaacactacctgctggggactatgctcactagctgggtgatgaaatcatttgtacaccaaaccccagcaacatgcaattacccacgtaacaaacctgcccatgtacctcctgaacctaaaatagaagttgagaaaagaaaaaaaaagatatcaatttcctataaggagctccaggtttgttccaaacagtagcgagacaaacagatcaaggatgaaatatataaaatagtaggcaaaacgtaaacaacatgtgtaaggcaatcgattctatataactcagcaactcctagggttcttatcaaataaaatcactgatgtgtcataacttctaaactaaaaacaacacaaatgcccattcacagtagaatgaataaataaattacttttgcttcccgcgatgaataccacacagcaattaaacaatgaactgctgctacacaaaacatagatgattctcacaaatttcaactgagtgaaacaagtcagactcaaaagattacatacagcaagtttccatttatatgaaattgaggagtagggaaatccatcgtgatagatttcatgataatgatgaccattggtgagtaactggttgagaaagtgcgagagccaggggtgtgggagctggaaatcgtccatatcttgcttgatttgggtggtggtgatagggatatatacacttataaaaattataatgctatatgcttaagatttatgtattttactatttgtaagatatatattagttgaaaaaatgcttcagtgtaaaggaaaccagtaaaaatacgctacctacaattgtagcttttgtttatcaaaaaagcatttgagtagtctattgattggtaattagcaagtttatgttaagcagccttgtcctgaatactttttagtatgtaccattaagcatttgcctttctcaactagggctaattaaaaaaaactcaaaacctcacattgtacacgttgaatatatataattttaatttgtgaattataccaccataaaactaaaaatctaattaagttgagtttgaatacattttagggaaaatacgataaagaaaattaggagcttaagaatatgcatagataaaaaataaacttgatagaaatattatttatatattatatattatgtatatttatatatatttatatataatatataaataataatatatatataaataatactatatgtatttcagaaaatcatataaaaagctgtgctaaaattttccagagagagagtaaatagttctcctgtagtggattaaaatgagattagcattggagtactagcgtaatacaacagatagagtctgaagtcagatctcaaaaatacaatatatttgctaagtaatgcgagacaagctatttaaagtttttggacctaaatatccagtctgtaagtttgttggaaaaaataaatacgctaatagagaacttaacttacagggagtgctaaattattacctgttactggaaaacataatatcagtgacattaaaagcttgagtgttgtagaacaatattttgaaatatcattttttgaagttatatacatatttatattactttaataatttgcacaacataggaaggaaagcttgctttgcacaggcaacatttttgccaaataatctttaaatcatcatgaattctcaattagattaacaataataaaattttattgtagaagactattttttcattaatatagttgtacatgcacatagggtaaatgtaatattttgttacttgcctaagctttataatgatcaaatcaaagtaaccagggtgtccataatctcaagtattatttccatatgttaagaacatttcaagtcctttagctattttggaatatacaatacattgctgtttatatgtagtcaccttactctgctatgaaatattagaacatatgtcttccaagtaattgtatgtttggacctattaacaaacttttctttattcctcccacccagagaaactttccagcctctggtatctatctataattctattctctacctccatgagatcaatatttttagttttcatgtaagaataaggatatgtgatacttgtttttctgtgcctggcttatttcacccaacacaatgacttccagttccatccatcttgctgtaaatgataaaatctcattcttttttatggacaaaaagtattctactgtgtatatatataccatgttgtttttattcattcatccattgatggacagaggttgatttcatatctttgctattgtgaatattgcaataaatatgagagtgtggttatctctttgatatactcatttatttacctttggacaaatagctagtaataaatagcttgcacctctggtctcagctacttgggagactaaagcaaggggatcacttgagcccccgaggttgaggttgcagtgagccatgatcactccactgcattctagcttggttgacagagtgagaacctctccctcctaaaaaaatccttaagaaatgtgttgatgcctggttcccttggtcagaattttcatttgatgtgttgagagtgtagcacagatgttggaatgaacctctcaagctgattttaatgtgcaaccaagtttgagaaccaccaaggaagagtttttatgaattaagattcctatactctatcctagaactaatacaactgaatctctgggaatggagtatcagaatcagatttgaaaaggtttccttagtaattctaaggactgagcagtttggatactcgtttgttagagtaaaatggttaggtacctagtatcaacataggcacccaacctgatattaataactaggaaaataaagggttggcgcctctgtgtttctttgttgaaaaatctgatactattcttagttctatgaaaacaattgaaaatttggttattatcaccttaaaagtacaaaacctatagatattgaaaatgtaattatttttctataggcatagttgaaatgattttgtaaatgttataaatcagtttctttataagcagttcatttacataaattttgttaaactgacatgattcactaattttctaaatataaatggttcagctctcagttatttttaaactaatgacctgtgttatacttactatttttaatgggcttttatgatgtttttaggtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatggaatagtgtttgcattttttgtttacctggtttaagatgtgcagcagaacataactagatgattacataatttctttttaaggcaattttataatatattttatttatgattataaaaactgcctttaaaaattcttacatggatatcaatgcagtttcactttttttattgtaatcttttttataattattttatacttgtctggcattgagttttattgggcttttggttttttggaagtagggtatttatcccaatttagaaaatttgtatccttgccataatacagtcttccatttttgtacccccaaatctttcatctgtcagaacatcactcaaaggtgaaaatatttcccacataaaattattctgttcctttaatgaaatgagtttcagctgtatataagtaggaaaacttccttttgttctatttgattcctttttacggatactttcttgaggctgtgattacacctttaccttagaggcactgcccaaaaagactcagctcttctgtaaaaatgctgttatgaatcatagcttcttaacttttacaacatagtgaggtagggaaagtaagaacactagagataggaattagaagcatggagaagtgaaccctggagcttcccaatggtgagataccaaatagttcaagaactagtaaagaagactacggaggaatagctagaagctaaatgaagaaagtatctcaaacaggaaggagtgatctgttaatgtgttaggaaagttgagttcttaggattaagcattgggtagagcaagatttgggaccttgactttgacgaacttggtggatgtcaggagtaagaggaggtattcaagagaatgttggagaggaatttaatatagtgagtattgaggacaacacttaaggagtcttgctttcaaggggatgtgagaaatgggttgttaatggagggtaatgtagtatcaaaaagctgtttattttgagatcgatgatatagtaggtttgtatgctaatgggactgattcagtagacagaaaaagcataatgcaggaaacagagggatattgctgaagccatagacctgggacacaaatagaagggttagttttaaagataggcccacaaacagctcattagtaacagcaggatgaagggcagattatggagttccagatgtttgtagtccagtagataggaggagcatgtcaaatttttgtgatattttctcagtgaaacaggaagcaagctcataaagagggaggaagtcacgaaggagtaaggaaggaaaaggagatgtaaaatgaatagataggagtgtaggaaagtaagcatactcttaggaaatctgtggtttatttaagtggtatcagtcaatgtggttctgtgtttttctccagttgagttcagcataggtgctatcactgaaaaagtacagaattcagtttaactaaaggtgagatttctctaggtgaataaaacagtcagtgatgagatgttgatacatttaagagaatgattataaaagagggatgtggaaagtagtctgggttaagtagtgaagtgagaaaataaagaaggttgagacagtggaaaatggaatgatcaattgtagattgcagtgtggttgaagatgcaatggacttcttgaggtgggaactagaaatttgggggatataaataagagaggggtgactgaaattgaaaatatgagagtataatagtatacaatattactaagtatggtatactaagtatagtagaatagtactaagtatagtagaatagtactaagtatatagtacttagtgagtataagttttaggatgtgaagaggggagtagcgtagaggcaaggtgatggaagcagatgagttcaagaaaatgagaacctaggagattgaaaccattatctaaatgaattctgaaatctcaagaagaactgtgctgagtgcttgtagtcattattttgtctttactactctgtgagaagacagcacttccttttgtgagtaatggaaagttctttaatatgtcaactgtaagatactttattacatttaattatctttagtaatgcatagtaataactaatgacctcagtaggattattcagtagatatgtgagctaaccccctgtgtcagacacctaagaggaacaactgatgtttttcaagacgaatagagggttctcatcccagggttttaagctgcaaaatatcccaccctatattttctgaaaacaaacgttatatagagtgtccacataaaagctaacaggaaatattacacacacacacacacacacacacacacacacacacagcattgaaaatgcatcaggaaagatataccctgtacccaacatgcacaaggtctaagcaatgaagaaaatctaggaaatcaaataagaccagaacatctatgactaatatataaatacttgaggcagttatatccatttaaaaggtgtcaattagacatgaaagaaaaaggccaggtgcagtggctcatgcttgtaatcccagcactttgggaggccaacgcaggcggatcaacgtgaggtcaggggtttgagaccagcttggccaacaaggtgagaccccgtctctactaaaaatacaaaaaaaattgctggttatggttgcacgtgcctgtggtcccatctacttaggaggctgaggtaggagaatcatctgaacccagaggtagagattgcagtgagctgagattgcgccattgcactccagcttgggtgatggagtaagattaaaatatatatatatacatttttacataagaaattttattttaatttttttgtaaattagaaaatagcaattaatatggtatttatataccagaatctttgaatatctaaaatttaagaagatgtgagcaatttcatgaaacttttcaaagcttagaaaaaggtagctatgtaaaataacaatgtatgttgtttatgggaacattagatgaagtaagtcatgaaaacatgcatagaaatgatcatataaacttgcaagaaattgaatgtcttgctatcaaaggaaaggatggaggtgtaagagactgaggtagaatgtgagaagctctgtatatattgtattttccttaaaaatatatatttaaactcgcatttcttgtttttcaaatgttcactctaatgaaaattcttttatttttcctgttacagtttttatttctgatctcatatatgcagtgtactgttgttcagaaatatcattgatcctccctgcaaatgaaatactctcatcctgttgaatttgagaatgtacacatgatttgctttggctttgaaatgtgagcagaaagaatgttttactttggggagttcccaattgctaaaccatgtgtcaaaatgaagtttttgtgacattacaaatggactaataagagtgcctttgttgatcctagttgaacatgagaaacttggttattgtaagccactgaaaaattttagtttcttttattactgcagaatagcctattctgtcctgattgatacagccacaacatttccttaagctctttgattttcatattgccattaggatgtagaatgccaagagaaggataaatcataggatcagagaatgttagcagtgaacgagactattggaatacattttttcaatggtttccagactttgggttctaagtaatcagtaatatttcgaaaaagtagtaaaagatatttcaatataaaaaataatgacatttaactttgaaaaaaaaaacctatcattgctaggcataatgggtctagcttgtaatcccaacaacttgggaggctgaggagggaggatcacttaaagtccaggagtttgaggctgcagtgaaccatgattgcatctccacactccagcctgggtgacatagggccacctcaacaacaaccaccaccaaagctatcattaatacattgttcctctgtctctcttcccatcctccttaccacttagtcttaaatctaatcttattaaacaatatctaaggaaaagataagaaaaatgatggttgcatctatactgaacatgtgttgacttttttcttgtcactattttctaaacaacacagtatcacaacttttgacatagcatttatgttgcattagttattataagtaatctgagatgatgtaaaggttatatgcaaatattatattttatataaaggacttgagtaattattactttaagtatccatggtggttcctggaacaaattcctcatggatatggagggaggaggaatcactgtaattaaacaaatcatcactttaaaacttaaaaccttttgcatgttgaatacagtcatgcaccacataaatgatggtggtcccattaagtttattatgccatatttttatcggaagtttcctatgtttaagtgtatttagatacacaagtacactgtgttacagttgcctatagtattcagtaaaataacatgctttacaggtttgtagtctaggagaaataggctaagccatctaggttaatgaagtccattctatgacatttgcacagtggcttaattacctaagggctttctcttcagaacctactcttgtcattaagcaatgcatgactgtagttggacaaaaaataataatgcaggcatacctttggcactgtcctaattcttaccagcatccatgattgcttaaatttgcactggaaagacttcaaaaaacagtgatatattaggacaatatatttccagtacatgacaaatgataacaacataagaactcgaaacactcaataaaaaacaaaaaataaagcaaaactagatgggaaaaggaagaagcaaatttcaagagaaaactcaaaaggccaaaaaatgtgaaatgatgttcagccttgctagtaattgggaaaaacacaaatcattttttttttttttttttttgagatggagtctccctctgtcacccacgctggagtgcattggcgtgatctgggctcactgccagctccacctaccaccttcaggccgccattcccctgcctcaggctccagagtagctgggactacaggggcccaccaccatgcctggctagttttttgtgtttttagtagagacagggtttcaccatgttagccaggatggtctccgtctcctgacctcgtgatctgcccgcctcagcttccgaaagtgctgggattacaggagtgagacacgtgcccgacccaaatcatttttaatctattagtcaaaaattagagctatgataatattaatttttggtgggagtgtggcaaaaggtactataatatactgctactagagagtaaaaattgataaattttgtaagggcaattttgcacaatatgaaaatataaaaatatgcttcatgtttaccatacatttatctagcatacagaattacccatgtgtaaacatgtatacagatgttcattataacacttcttataaaaacaaaatatttggaaataaatgttcatattaataaggcgcataccgtatgatcttagtccagttagaatattctgttttatttcaatcctttaaaagactcaacttctgactctatatagacgattaaaaaaagaatgtgttctccctttgtgcatttggtcaggtaaattaaaaaatacaccacatgctagccgcaccaaactggaataagcctttggaaagaagttgtccttgaagcttgtatctgacattgtagcaggacgagcctcagacaaaacctctcagacactgagttgtagaaggaagggctttattcagctgggagcatcggccagctactgtctcaaaatctgagctcccggagtgcacaatttctgtcctttttaagggctcacaacactaaagatttcacatgaaagggtcgtgattgatttgagcaagcaagggatacgtgacaaggactacattcactgctggtcagggagaaacagaacagggcagggagtttcacagagttcttttatacaatgtctggaatctgtgaataatatcagcttctaaatcataagttgatttttagctactgggtttaggccaatcaggcccaggcctggtttcaggcctggcgctgggctgcatgtctttggttgtacttcctggttgtttttactgaatagaaaacaatataaaacaaggagagggtctttgtctcctctcaatatcagcactggattgtagaatgtgttgctgattttgaccttgtattcaagttaactgttgcccttggtatctgtacatatctttgatttcagtctttactacacgtggcttggtcacttcatggctaaaaacatgcttgtggaagaccagtctggctcggtgagtctgtgcggccagcagtctctgatctgtacagggtattaatgtgtcagggctgagtgttctgggatttgtctagaggctggtaagggcttctggaccacttgtttctgtcctgtcagtctgtcagggttggaaagtccaagccataggacccagtttcctttcttagcttacgttatctaccagagcaccgtgggctgttacttaccttgagttggaaggggttcgcatttatacctgtaaaagtattcatccttttaatttatgtaaagtttttttgtatgccattctggatctttaaagagatgacaacaaattttggttttctactgttatgtgagaacattaggccccagcaacaggtcactgtttaaggaaaaataaaagtgctgccagaacctaagaaaaacattaatatctaaaaggtcatttagatgatttccatgagagactttttgatgttctttacctgttaggattattattgataatccttttcagattatgaataaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtgggtatgattcatagtatcaattgcggaattcactgtgcttgtaggaaatagtattctgatcttatctgtgaagcttgggcaacattttacttcacaggtaagtattctaagtaaaagagatttctgagggaaaatctatgtagtattcttggcaactttatattttgtttctgagataatctttcttcaccaagagccctccaatgtgctgttaatattttcaagagatagctgcctataccaagattcaagaatcttttatactattgattagtttctagaacattcaatgatacacagtaagacagaatttggtacttatgaagactgtttaatttgtaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggtaagtgaattctagtttcctttaaaaataacagacaggaaaatggtttctctctcttctttcttgctccttttcagcagaaaattttccgtattttatttttttaattttacttcataatttaaaactcaaaattaactgtttatttatgttcaacttttgtgaatatttgtgtgtgtgctatctactaaagaggtaagttaaagtttaaatcagaatttgcttctaaagcaaaacatcaaattttaacccttataactgttcgtatttcccggaaacaatttactggttaggaagtataattccagttacaatgtttgctatcatttttaggtgacttgtgtctccatccgtaattcttgggtttttcatggtgaatagctagcttctctatttaatgaggagcataaattgagattaatagctaccttgtttgtcttcaaaagcttcatagagagtacaggctttctcctggtgacccactgaaatttccaaaacaataacctttccactctcatctgagttttgtcttcccaaagtgggctttttgcatttcctcctatttatggtagtttctggtctctcaatttatcattcctataaatatttgaccaagtgtctagaaggcatgtaggtgtttagttcacattactttcctttcacagttgatttttgatcttgtaggaaaataattataagatatcatgaaatattttggagttttattaacatactataaacttgcatcaataatgctttaaatttctacctctctgtaagtcacactgaagtagaaactttgttttctaggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtaatttttttacgagagtgatctgaataaaagagtaatatatgccttttcttgtagacatgtagctaattgaatttcatttaaaataggaatttagatctcttagggacagaagttaacaagtttgactactttaagaaactcaaatccatatttaagaactttcaaatattgatttaagatttttaatcaatacacatttgcccacttctaagaagttcccaattaaaaatctcatcgactttatttcctaaattctctattttctattagaaaatatttcaaagatacatctgtagtagaatgtgagcatccccagtgcccaatgcaaggaagtcactatagaatatctcttgaggaatcatggaataaatgaataatccaatggattctcaggagaaaaatgaggttttatgaatcaatcataacatttttacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacttatatgcctataaaatatcatcttattcgttagaaaattaatggaagatttaattaaaaatgcaatttctgtaggataaggaatgagacatttacataaaacagtgttctttaacctcctcttcttcacatacagcatatctaattctttatcacaacatgttttatggaggtacacagaatgtaggatactgataatagttatgtctttactttctttggataatgaaacaagttaatatttatcaaggaatttcagtcgatactaaatgttttattagtgtgagctcttattattatcattgatgtagaagactaaaaattaggtaagtattttcacaggacaacaggtatctttgacattatgcttctttcaatattgtagcctatactttatcaaataaaagaatataagaatattacctgttgagataataggaataagaaaaccattttgcacatttcgtgtaacaaacaggaccaggcatggtggctcgtgcatgtaatctcagcactttgggaggctgcggcagggggattgcttgaggccaggagtttgggaccatcctggacgacatagcaagaccctgtctctaaaaaacaaaacaaaacaagacaaaaagaaataataaatagcttaatttattaataaataacaaatagcataaagctatttttatataatattaacttattggttaaaatgctttaaagtccttacacaaaatgttattgtttcctaaatttctactaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttccctgaagtatttcatggatctattagtcatactacctcagtgtgacttatcttctggaacattcttattcagacaactatcaaagagtcaattgtgaatgataagtattctagtgccctaaactctaatcaatcatcttttgtatttagagtgtctgtcacaaggcaatatgtctaggaacgctaaacataccctaggagttttcatctaagtacgagatgaatatactggatttgactgatgtttgcatataatcttttaaagccaggttattattaaaatgatcctatcatttatgaagtatgtacaaagtttccatcctgtagaatttacatgtattatatgaattaaaaatataaaaaatatttatattataacaatacagtattgaagccttattttaatctagtttgattaaactagattggtctagtttgattaaactagattaaacttcttggtctaggcacatgaatattgttgtggggaagagaattctgtataatgtgatatggatattgatccttctggagtgcctctaaatgataatgtgctgaaacctctgaaaggaccttttttaataacaaaaatcttatatttgtaatatgaatgtaagtattccatacatgtatatacaaatatggaccatacatgtagattacacatgtgtgtgtgtttgatgtgtgtgtatatatatgtgtgtgtgtgtttgtgtgtgtatatatatatatatctcttacaggaaaagcatttaattagagaaagaatttaatcttcagatgccatgccttacagagagagatgcacagttaagttactctcaaactgttgtgaaatgatacatcaacgtatatcttatttttcaaaaataggaactggggagaaggttggggtttcgtaccttctgacagagcgcttgtctttgtggataaccatgacaatcaacgaggacatggggctggaggagcctctattcttaccttctgggatgctaggtagaaaaccaagttctctatttttttaacacgtcttttaatgatggcaagaatattctgacatcctatgaaaatataattatgtaacttccaggctgtacaaaatggcagttggatttatgcttgctcatccttacggatttacacgagtaatgtcaagctaccgttggccaagacagtttcaaaatggaaacgtaagttttggagttgttcaatatatccttttctgaagaaaaaggaagcaatcttattctaacttaacatgacaactattaattatatatttattcaacaaatatttaattgattgtaaactggatacagggctgtgattttagtaatgtaggttatattaaaggagtaaaatttatattctccattgacaaagagtatgcaagctgtttcagagatatgacaaacatccccttagcccgcagggaaacaaaaaacaaaaaacagaaaaacactcaaaactaagagctagacacagggattaaaatatatacttcgaataagtacctacctcagggctgataggaagattatacatgccaacacttttagagaacttaaaacatcatctgcccgtagtgagaacaatataaatgtttgttaaatacttttaaaaagttatatggaatagaaagaaatgaatcaattgagctgagttaaatagggaaagtatcatataagaggaaggaaatgatatgtactaaagaatagaaatttagagagtattccaagaaaggtaagaatgagaaaaatatttgggagtatggtaaagacattaatctgatgagaagtttcaaaaaggaacagagaaattacagtgtaaagatatttggaaagctagtagaaggttttcttttaaactaaagggttcagaaacagcatcagagacttcagaactaaagcagaaattcctccttcctatgagtcacacggatatctagctagctttttttagattcctttcagtttgagaagtccgcactttgtatagcaatttattctattgttaaacagctttaatatttagaaggtgtacttttatattgagccaacttcttttaatttctactaattggtcttatttctgatgttaggagtcatagagtatttttattttttctattactataacatttccactttgccaggactgctgcatgctaaaaactcttagttttgttcacttttcaccatatgacatgattctaaggtcaacactgaaaaacttcctaagattcctctggattttttaatgaagattttttaaagtgccaatcagaaaaccataatatgaaaaatgtggtcaatttataaataatgttcagatgtattgttttgtacatttatctaaaaagaagcatgaatgattctaatatttattcagcacatgtcacattcaaggcattttcacatatattacttaatttttatagcaaaaaaaccaatattcccattttacaaatgaagaaactgagacacagagatattaagtgtattgattaaattttctcaggtactagtaatagagcctatgttttaatcctggtgtttctagtactaatgcccttcccatttcaatgacattgcatggcttaccacgatgttaagaagctcttgcaggccaggtgcagtggctcacacctgtaatcccagcacctagtgaggcgaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgatcatgccactgtactccagcctgggtgacagagcaaagaagcctttgcagttctttggaatgaaaaggagaggataaaaatttgttaccttgtttgaaatatgccagaagaaaaccagaggatagagagatgatgaagacccagtaaagggctataaacattaatgaaggcattggattctagataaagtcactgaatgcagagacacaagtaacaggattggttgggtttggtgtaaaggagaaggaagaggtaaatacatgcatagtaaaatttggctttttcccccctacttaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccactgcattttatttaaaacagttgaagtttaagaatatcaacgttttatatggtattgtgtttttaggaacatggttattttccgcaatgtagtggatggccagccttttacaaattggtatgataatgggagcaaccaagtggcttttgggagaggaaacagaggattcattgttttcaacaatgatgactggtaagtaaatatcaattaaaaataatattttgtaccagtatgttcttggtttattcttttttttctctgttcattgacttttatcatatctgaaaaatcatgtagtcagtggagcaagaagacaatagagatcaaaattgggcagaagcaaaaggatgatggctgttactccttcgttctttttttttcataagtgctttctgttgtaagcagaatcctttctgtgcacccttgcagtatcatatgcatatatatgatgcacatgcatatgctcacctacacatgccacaaaatcaatatataaaatcacaatcaatataaggattgtgaaatcattaaaaaaaagtgtcttataatcctgcttttttaaccatggagaaatgctgcctaggtactaaaatatctttatttctaactctttttctcaatgactgctctacgtagttttttggtacactttcttcacttctctgtctccttgtgacaaataacatttttaaagcacatgtatgaataatatgtatcttgtggttactgttttgcttcaggagatttgagttttatttttgaaacttctcattattggcctttcatctgtgattcttatatgctttacctgaagcataaatgattatctaagatatagctcagaagaccttggtgtaaacagttgaattgtccctgtccaagaccaactgacactcatacttagctcactctagtataaattatatttcactgatgaaaagtaaataaatacatcaatatacaagtcaagttgatctctttcctgccaaaaaagcccatgtctagttttttaatttctttcttttgtagatgaaaataccaaaataagtttttgtgaaaaagctttatatttcaaactatcacttcttcatagaaatgctagattatttttatgtgcatcccaaattcgttttgatctcatgggagaagaaggaggttaaaaaataataccctttaaatttttaagagtaattggtattaatttcagttgagaacaaatttgattttaccaaggtagaacttttatcaaagtgtgaccgttcctgccaatcttcagtgatattcttcaactttgatgttttggtaatattttcactactaaccaggaaattgctaggttttctgtaaggttacttttggtcctagaaagctatttccacctactagagaggcatatgggttttcttcttaataagacttcactgcttaggtttgtttctacaacataaagttatgctgtttatttgtgttagtctgtattcttgattttcattgtattgaagatcaaccttaaattttattttacaggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaatagccaagtgtgtttcttttcttacatgtacagcagtacttatatttcattaatttttactaaaagctctaattagtaattagaggttcaaaaaagttgatagtgtgaaacacaattccaggttacacagaagttatttattttggcaaaaggatgtctcagaaattttaaaactaggcaacaacctttactcattaagagggaagacttagctttccaaacagtctgtctcctgtctactcttttctctccttggcagtctaccaacaaggcaaaccaaatatttcattattcttctctattacatgaaaaatctgtacaagggaaagaaaaccaaattttacccttacattggtttcaaaacattcctttttccataggcaacgtttacatttttatgcctttttataatcttttatgacaaacacattttactgtttttacacacattttacacactttgcatgtaaatttatttttagttgtcttatttacatgttttaatggtaaatcttaactttgccattttagttaaaatggtaactttaatgtaaaacctggtaagttttttcaattatgtactagatgcagataaagtctgactttttccatcctagttaggggcatggttaatttcatatgtccccaggccttatcaagttgtaaagtaggcagtatacaaccttgaaacatttagcaaacctggtatctaacttatatgatttaaacctcctatttacgtgttgatgatatttgcattttccaatttgatctttaaaacaatttttatttcttagagatgaaagtcacataaactaaaaggcattgcagttttaactttcctctaaaatgtttgatttaagtgcatatttttatttcaggcaatcagttatagctcgttacagacatcacacacaacacatatatcattacacagacaaacagaagcagatccagtagttctaagatttcttcctgtcccacttcctaattgaattattggcttcccagtagagccctttaagagcagggatagaaaaaccatgaagtttctagggcctaatcaacttgtatagctgtaagacaaaagcagattttgagtgggatctatcagcctctaaattctgggattccatcaggaaaacagaggtttctcccaaaatggaatccactgtgccttttctgtttttcccaaaaagtttcaggccaccagacattaccttgggtgcatcaagagtggaaagacagagcggaggacagtaattcagccaacagaaaaattcttttcaagaaaaacacaatccaagaagagaaaaacatacgggccttttaaatatacctataacttgaatatccacttttaatcaagctgagcactctttcagaaattcctttgaaatcttctgttacctgactttagctaaatcaagcaggtaatatttctggcttttgaactttactaaaagtaacatcacaggtgaaaacaacaactctcaatcaggttataagttaactgtgagtattcaagatattttataagtggtggtaagcagcttttactagatctagaaactttaaaggcaatttagagaaaggaagatttcagaaaggaaattagagttgttcatggaggaggaagagatgattaaaggtcatacagctattaaattgaaagtattcatcacccaagctaggattgaacctgggccaccattgtaaaatggcaatggctaaaaaagtcctgccacaaggttacaggttatgctcaagacataaaacaagatagaggcatgcagcaaagtttgttacttaccagtttatgtgggtgacttgaatagtgagcttatggagtcccaggcctggattccattccaacgtattccaacccgttccaagatgggttgttacccatgcagaaaacggggggaatataaggtgtcccttagtctcctttctccttttgaagtgacccaggatgaagcaaaagattacaggggtgtccctgttctcctctttcctcccatctcctttgggtcccggtaaccatcataggtgctgtccatggatgaaagcatgaattgcacccatggatgtggaggtgctagctggcaggagtagtcatttttaccagcacaatgcctcctcacactgctcttctgggttcctaggcctcccaggagattctacagtagataaagttgggtgagacactttaatagagggagtgttttaaccctattcctgcctcctctagttatggacctggaaaagcagtgcattcccagaaaattttatccattgacatttaaatataaaatcccctttctgtttaaatgccaatgtggttggaagcagaacaggtgtctcaaaagaacatatagatttaatggctgtcctccttctgatggaaacagcactaaggctagaatttgtctctcaagggtggcttcctcccaactgttgaatgcggagtttttttccttagaaatggggcatagggtctgcttgctgttagaggaacacaaaagagggagaaatctgggcattagaattttttggcgaacggccaccaagaatttttacggagaaaaatagcctatctcatgaggtggtgctgtagggtctgaaaagttatgtaaaatctgtgactctaaattttttccaggaagaagttagaaagagaggtttggggtttaacaggctgtcactgtatatgcctcccagcagtagaaaattaacttgtctcattaataaactgttcaaattcattcagcagtgctgagcttttacatgaaggaaaagcaactgaaatggagagggatgagggtattcacttggggtgaaatatcttctcatagagtgccatgaatgactgctattgcgggacaagaagcacttactaggtgaaggtttagactgaaatcttgaaatcccctggtattttgtgtgtctgattacctttccaaaggaataaaatcagatatgtatccatctcagtgagcagaggggtgactttgagtagaatgggaggaaggtttgttctaagtagtttcccgcttgcattttccccagtgatttcaggggcccagtatattttcctttcacacatctgacaagggattaataaccagaatatctacggagctcaaacaactctagagggaaaaaaaatctaataattgcatcaaaaagtgagcaaaagatttgaatagacatttctcaaaagcagacagacatatggtaaacaagcatatgaaaatgtgctcaacatcattgatcagagaaatacaaataaaaactacaatgagatattatctcaccccagttaaaatggcttttatttaaaaaacagacaataacaaatgctggtgaggaggtggagaaaagggaaccatcatacactttttgtggttatgtaaattagtacagctgctatggaaaacaatttggaggttcatcaaaaaactaaaaatagagctatgatgtgatccaggaatcccacagctaggtatatacccaaaagtaagaaaatcagtatattgaaatgataactgcactcccatgtttattccagccctgttcacaatagctaagacttggaaactacctaaatgtccatcaacatatgaatggataaagaagatgtggtacatatatacaatagagtactattcagccatggaaaaatgagatcctgtcatttgcaacaacatagatggaactgaactgtacattattatgtgacgtaaaataaaccggcccagaaagacaaacatcacatgttctcacttatttgtgggagcagcaattccaaacaatggaactcacggtcatagagagtagaaagatggttactagaggctgagaagggtggatgggaagcaagtgtgaatgttcaatgagtacaaaaaacagaagaatgaataagacctaatatttgacagcacaacagggtgactatcgtcaataacaacttaattgtacaatttaaaataactaaaagaatataattagattgtttgtaacataaaggtaaatgctcgtggtgatggataacccatttaccctgatgctattactacacattatctgcctgtatcaaaatatgacatatgccctataagtatatacacctcctaggtaccaacaacaattaaaaatttaaaaaagtgtatccttcccagtgaaccgaaatattttacattgatcatttttacattatcatagtgtgttggaataatcatagctttggaaagaaaaaaaataaatgtaaactttcaaagatggcaggagatatagatctctctttctttagtggatttaaatatgcaatttgttatcaacattgcactgacaatttttaacacaggccatattctggaaatgatatgattataggagttataggaaaaagcattttttcatactgtgattatctaggctatgaggaaaagagatatttcctctatgatgtctaatttagcataattattctttttaaactatatttagatttaattaagagatacacaaacaaattacttttagtagtaagaagagtttttaaaatgttttgtgtaagatgactatgtagtaaagaaggttacaaacctgctttttaacttagaaaaataatctcaccttcttgccccatggaaaattgaaatgttatgtggaacccaatgtacaaaaactctcagtgaggatttctgtcttaagtttcaacggattgaggtgagatcagtgcctgttccacctttttcctccctgtcctaggtgacttgataacatttatacagccataaaattttgcttttaaattcaagtatagaaaataaactttaaaatgtgatatttttatatattttaccttaataatttatatgggaaatatttttgaaaggttaaaaaattaaaatttttaaaagagtatagtgaaataatctaatcacatgtggaaattgtgttactatttccccaagcattttttgtacatgtaattgaaaatgagttgaatgtaactcataagtagtataaaagtgtttaatatttaattttctgctgcagtaatgtgacataacaaccttaaattcttggtactttaaacaagatattttttttctcccaaatttctaggttatttaagggcagttctgcttcatattgcagtttgcctgggctttactccaggctgtgtgttggagttaggtctaatctattgtatccctacacatcccacttagaaaagctaacaaatttcctttggacttcagtcagttcgattgtatttgtcattcaaaagccaaatcatttatcctaacaccaacggcttatttatttatttatttgtttgtttatttatttatgttttagaaggagtttttctcttgttgcccaggctgaggtgcaatggcgcgatcctggctcaccgcaatgtccccttcccgggtcaagggattgtcctgactcagcgtcctgagtagctgggattacaggcatgcaccaccatgcccagttaattttgtatttttagtagagatggggtttcttcgtgtggatcattctgttctagaactcccgacctcagttgatccgccagcctcaggctcccaaagtgctgggattacaggcgtaagccaccgctcccagcctaaccgattgcttcttttgttctgtagtcttttgccaaaactgttattctctggactcactttcaccttctctcacacatacatgtccctcgtgtccctttgtgtctccagggtcttctatttccacgtaatcttaatttttcatcacatcctggactcatgagtaattaatctgttattctccctgaaagtgcagccttgttgaatagaatgtgttctttaaacagcagctttgtttctcgagtgaggtattaacttccagatttaggtgaaaatgagttccaagttttatgtttcattgtgtgtctaagactgacaccgtttattaccgtggcacttacagcttgctttcaatgcctccaaattctctatctgaaaggctgggtaccatatctcatgtctgaacatagtcctcagaatcatgcagtaccagctatgttccttctgtatattatggcttccgaggtgcctgttaagcagccaggtgaaattgccttttaatcaatataggaaccagtctctttcctggtgatgctaatgctttttataaaaaggccatgctgtattgaagttcttctttcaggacaaaaccactaatggaactcatctacctactgatgggtggaagctcttggtatgccaaagtcttgttttgtttgtgaagaatctctttccctcaacagtgatgtgctacgttaggtctcaaatcattgttgcgttttaatccaaatttatgacaaagattttcagtttgtatgcataatttccttctctggccttaaccatcagtctgtggacttgccaagcaacaacaacaacaagaacaacaagtctgaggtcaagagacactatttagatctcagaatcatttgttgtcatttatcctttgataaagttttgcctttctttctttatgagtatatttcctctcatggtttcccaatctcttgagaaaaagaaagttcttgcctcttgcagtctttctcattagttgaattataccagcagttcagcttctgatcctgtcgagaaatccaccatgaagaaataaaacatttctgattacatggattacgtttcctggattcttataggcattaaacttagttctaggatacaaccgcatgatcttctcttattctcagaacaagaaatatattactatatacattacagtttgtatatattgcagtttatatagagtatatgtatatgtactgtatatatatatgtacacatatatataacagtaaaccctgtaggcaagcaggaaaacttcagaattctcaatgaatccatcattagctgttagtaatgacaacactattagaagtatttcaataatcaaacattgttgtggtctgtatgtgcacccccaaaagtaatatcttgaaattctaacacctgagggcatagtatttggaacttgggagtggaattcttttttgtgctattatgaataagatgcttgcctcttccatcaaatgaggacacagccacaagttaccctctaggagctaggaagttagtcttcaccagacacaaaatctgcttgattttgaatttagtctcctgaactgtggaaaataaatttctgcttttataagccactcagtttatgctatttggttatagtggcccaaagagagtaaaaagacacattatttacctcctttgtggactctctggagttgttgctttaaacttgctttagtgcctaacactgctccaactccctgtcctttagcacacacggataaataattctgctgggaactgacatgtttcactcaggcatccaaatgtatttattatgttgtcaaaatatatagcacttgttacaatgtttccatgttagacatattttgagatatatgccttaacactgtgctgtgattattattaatatctagtaactaatcttaccatatctaaactcaaagttttcacgataacactgccttattagggactgaattttttaaagtatgaagatcttacatcaagtccaaattgattcatctgatagtctcgcagtaaaatcaacgccacagaattatctattctgtttcttgtcttgttgtagctgatattctgtgattggacatattgctaatatctattaaccttagcataaaatgtcatattgaaattgaagaggaatattggaacttggctaagaaagattgcttttcagacacagtgagaactaaaatggaccctctgttcctggaggtatattttacaaaaattgggtgctattataggaattctgtacaattctatcttatgcacttgtgttccatcagtgtcaatcctctctgtattttaaattgactatgatttctttttccatctttctgtttgtcaagtattcttttgctgaaaatttgttattcatgttccaacagaaaatagattttttttcttttaactcattggaaagaatatttagagtctttagtgacaaatgacatggtataaatgaaaagaaaatactgacattgtacttgagaaatactaattaattgggagaatattaattaaaagacattgtttaaatatttctatcacaaattgacagcagaacaatacacaccaccagcaaggtataatagtagatatgagaggtaaaatgattaattagatattgcattttctccagaaaacttattatttagtggaaactggccaataatttcttaggccttaggataattttacctttgattctctagttaatcaaaaatatataaaaatattaaccaaaagtatatatttttaaaatacctacataatctaatgcagtatgtttcgctctcttcttgaagtgaattaaattccttatcactgaccataaaatttaactacatagatgattcttgtttaaaatagttaaaagtgaacgtaaagatcagttttggttttccttttcttacccccgttttttacacttatatttgcctgtgtcattcatatacttttagaatccaaaacaataattaaaaacataatcatttggttttcaaaagctttttgcatctctagaaagttaatatagagtcttataaaacttttagctaattcaaaaacaaatcacacatatataattgaagcaaactttgtttggtagacttcttcgaaccacagaaatttcagttatggcatggtaggtcttttgaaatgtttcattttttatatttggagatgcacaacaaaagtctttccactccaactcccctttaataaaaacagaatgtaacaaaaatatcaaaatctgtaggaaaataacccattcgtctatgttaaagctatgagatttccagcccaaataaattataagaaccagtatagaggccgggcgcgatggctcacacttgtaatcccaacacttttgggggctgaggcaggcggatcaagagttcaggagatcaggaccatcccagctaacacggtgaaaccccatctctactaaatatacaaaaaaagtaattagccaggcacagtggcgggtgcctgtagtcccactactcaggaggctgaggcaggagaatggcctcatcctgggaggtggagtttgcagtgagccgagatcacaccactgcactccagcctgggagatagagtgacactctgtctccaaaaaaaaaaaaaaaaaaagcatgtagaaatactaatacagtgaaatctggactgatatataaagaaaataaccaacagattttgtctatggcacaaaattcttagaaattttgagatctttagccttatagacctaacaaaatatttattagtttgaacagtgaggtactgggatatgctgggctttgaggctatacgcaaatctaattttagaagtcaggaactgttgtaagcaatagcaaagaatatgtttgatgatcagcttggcaattgttgaacaagcttcattcagcactgtgaggatgtaattaaagcagttgccctgcaatctattcactctcttcactggcgaatggcccaggcataagactagaaggaagatgaactggtttagtctctttgtcagctgaaattttggtgaaagagactactgatatttttctaggatgaagggatcttatctctgaaataccctttgcaggttattcctggctgaaacaaatgcacagatcctttcttcttgatcaattttgctgtcgattctcattttacattctttatttcatttattttattctttagctccagaatttttgtttgggttccattttttccatctctctgttgaacttctcatttggtttgtgttttgtttttttcaagttttagttgaattgcctatttgtcctcttgtaactcattactttcctttaaaacaattatttgacaggaaaaactgcacaaaaatagaaaaatctataaatcacatgacgaagaattcaaaataattattttaaagaatttctgaatttgcagcaaaagtttgctatagagcaacatgaaagcacagaaaagtatgaaactcattgattaaggtaaatatataaaaaatgcagaacatgctaatagtataatagtggtgtgtaaatctcttttattgctagtatgaaggttaaaataccaaagtaataataattatagctacaataatttgttaatagatacagaatattaaaaatatataatgtgacatcaaatatataaaatatggtgggctgagtaaaagtatagggttttgaatatgatcaaagttatcagtttaaaagagtttgctccaattacaagatagtatatataagcatcatgctaatcaaaaagacaaaacctatggtagatacccaaaagataaagagaaatcaaaccatgtcagtacagaaaatcatgaaatctcaaagaaagacagcaagggagaaataaagaaactaataatatgttaaaaagccaaaaaacaatgaacaaagtggcaattgtatgttcttacctatcaataattaccttgaaggtaaattcattctattctacattcaaaacccagaatggctgaatggattacaaaagaagacccatcaatatgctgcctacaagagactcacttcagcttcaaggacacatatggagtgaatgtaggggatgagaaaatttgatattccatgcaaattaaaaccagaaaacagcatggatagctatccttatatcaggcaaaatatactttaagatacaactgtagcaagtgataaagatggtcattaaataatgaaaaagtggtgagttgattaaagggatgaaacaattataaataaatatgcacttaacattgaagcacctgaaaatataaagcaaacattaatatctggagggacagatacacagcaatcaataatattagggaaataggtaaccttattgatactgttgcaattatcaatactccaattgcaacaatggatagatcatttagatagacaatctataaggaaaaaaaacattagacttgatctgcactttagaccaaacggacctaacagatgtatgttcacatttcatctacagctggagaacaggtgttcttctcaagctaacaagaaacatcctccaaaatagagcatatttgaaattacaaaatgtcttaatacatttaagaagattgaagttgtatcaagtatcttttttaaccacaatggtatataactagaaatcagcaacaggaggaaaactggaaaattcaaaaataagtgaacataatgcaatccttaacaaaaagtgttttaaaaaggaaatgaaaaggaaaataaaaaatcttgatacaaaaatgaaaacacaatactccaaaacttgtggcatgcagtaagaccgtgctaagaagaaaatttgtatgacaaacacctacattaaagaaaaaacatctcaaataatctatcattaaacctcaaggaactagataaaaagaagagcaaactaagcccaaagctaatacaagaaagcaaagaaatatcaaagcaaaataaagaaatagacagtagaaaaataatagaaattgaaagactttctgtgttcatcaatgggagaaatcaatactgtcaaaatgctattggacaaaacaatctacagataaatgtaatccctatcaaatgtccagcggcatttttcacagaaacagaaataaatactaaaatttgtatgaaattacaaaagactataagtacctaaagtgatcttgtgcaagaagaacaaacaggaggtaccacacttctcactttcaagttatattacaaaactacagcaaattttatatatactgacatgaaaacagtgacatagaagaatggaacagaatagaaagcctagaaataaacctacaccaagacggtcaaaaaatcttcaataacatgcccaaaatacctaatggagacaggatagtctcttcaataaatagcgtttagaaaaactgcaggcccacatgcaaaataatgaaatttgacagttataatatgcacaggaataaattgaacattgaaaaggaatttaaacttaacatctgaaaccaaagaatccctagaagaaaccaggggaaatcctccttaagattgaccttggcatgattttttggctatgaatctcaaaatatagacaagacaaacaaaaataaacacatggaactacaccaaagtaagaggttgctgcacagtaaaaaaaaaaataataattaattaattaattaattaattaaaaaggtcacccatggaatggtagaaaatacttgaaaacaatatatctgataatggattaatatctgaaacagataagaaactaataatcagaaaaaaatcctgattagaacatgagcaagagacctgaacagacttttttccaaggtagacttgcacatggccaacacatgaatgaagaggtgcacaaaatcactaaacaagtgggaaatataaactgaaatgaaaatgagatgtcacattacatcttttaaaatggccaatataaaaagccaaaagatagatagtgttgacaaggatgtatcaaaacgagaatgcttatagagttttggtgggaatgtaaattggtacaaccattatggaatacagcatggagggtcctcaaataattaaagacttaccatatgatgcagcaattatacttttaggtataaatttatatacctgtgggtgtgttggctcacacctgtaattccagcactttgagaagctgaggcaggcagattacatgaggtcaggagttcaagaccagagttgccaacatggcgaatccctgtctctactaaaaaccataaaaattagccaggtgtggtggtgggcacctgtaatcccagctacttgggaggctgcggcatggagaattgtttgaacctgggaagcagaggttccagtgagccgagaacttgatgccattttatataattatcctttcacagacaaaagaaatctaatcactatcttgaagagatatctgcattcctgtgttcattgcagcattattcccaaaacccaaaatatggaaacaacctaagtgttgatagatgagtagtatgtgaattgtgatatctatcatctatctatctatctatctatctatctatctatctatctatctacaatggaatatcattcagtattaaaaagaatgaaatttggccctttgtaacaaaatgaatgaccctagaggatattatgctaagtgaaataagccaggcagagaaagaaaaatactacaggtacaaccatgcaaacttgccattataagatgaataagttagggagatctaacgtacaacatggtaacaatagataataataatgtatgctttaagttcatggagtgtagatcttaagtattatcctttcccaacatgtgataactatgtgaagacatgaatatgttaattagcttgatagtgaaaatcattttaatatatacttgatgggcgcagggtgagaggagagtgagggtcaaaacactacctgctggggactatgctcactagctgggtgatgaaatcatttgtacaccaaaccccagcaacatgcaattacccacgtaacaaacctgcacatgtacctcctgaacctaaaatagaagttgagaaaagaaaaagaagatatcagtttcctatagggagctccaggtttgttccaaacagtagagagacaaacctatcaaggatgaaatatatacaagagtaggcacaacttaaacaatgtgtgtaaggcaatcaattctatataactcagcaactcctaggcttcttatcaaataaaatcactgatgtgtcataacttctaaactaaaaacaacacaaatgcccattcacagtagaatgaataaataaattacttttgcttcccacaggggaatacggcacagcaatgaaacaatgatctgctgctacacaaaatgtagatgattcttacaaacttcaactgagtgaaagaagtcagactcaaaagaatacagatagcaactttccatttatatgaaattgaggagcagggaaatccatcgtgatagagttcatgataatgatgacctttggtgagtaactggttgagaaagtgcaagagagtggttgtgggagctggaaatactccatatcttgcttgatttgagtgatgatggggatatatacacttataaaaattataatgctatatgcttaagatttatgtattttactatttgtaagatatatattagttgaaaaaatgctgcagtgtaaaggaaaccagtaaaaatatgctacctagaattgtagatttgtttaacaaaaaagcatttgagtagtctattgattattagttagcaagtttatattaagcatcattgtcctgaatactttttagtatgtaccagtaagtgtttgcctttctcaactagggctaattaaaaaaaactcaaaacctcatgttgtacacattgaatatatataattttaacttgtgaattataccaccataaaactaaaaatctaattaaaatgagttcgaataaattttagggaaaataggataatgaaaattatgagcttaagaatatgcatagataaaaaataaactgttgatagaaattttattgttatatttcagaaaatcatataaaaagctgtgctaaaagtttccagagagagagtacatagttctcctgcagtggattaaaatgagattagcattggagtactagtctaaaaccacagatagagtctggagtcagatctcagaaatacaatatatttgataagtaatgagagacaagttatttaaatttttgggacctaaacatccagtctgtaagtttgttgaaaaaaataaacaggctaaagagaccttaatttacagggagggctaaattattacctattattgtaaaacataatagcagtgacattaaaagcttgagtgctgtagaacaatatattgaaaatcactttttgaagttatatacatatttatattactttaataatttgcacaatgtaggaagaaaagcttgctttgcacaggcaacattttgccaaataatctccaaatcatcatgaattctcaattagtcagattaacaataataaaattttattgtagaggaggattattttttcattaatatatttgtacctacacatagtgtatatgtaatattttgttacctgcctggactttacaatgatcaattcaaagtatccggggtgtccataacctcaagtattatttccatatgttaagaaagtttcaagtcctttagctattttggaaaatacaatacattgctgtttatatgtagtcaccttactctgctatgaaatattagaacttatgtcttccaagtaactgtatgtttggacccattaacaaacttttctttattcctcccacccacagaaactctttccagcctctggtatctatgtattattctattctctacctccatgagatcaatatttttagctttcacgttctattcttagaataagaacatgtgatgcttgtctttctgtgcctggcttatttcacctaacacaatgacttccagttccaaccgtcttgctgtaaatgataaaatttcattcttttttatggacaaaaactcttccactgcttgtatatataccacgttgcttttattcattcatccattgatggacacaggttgatttcatatctttgctattgtgaatagtgcaataaatatgagagtgtggttaactctttgatatactcatttattttcctttggatacatagctagtaataaatagcttgcacctctggtctcagctacttgggagactaaggcaagaggattacttgagcccccgaggtttagattgcagtgagccgtgatcacaccactgcgttccagcctgggtgacagagtgagaccctctccctcctcaaaaaatccttaagaaatatgttgatgcctggttcccttattcagaattttcatttgatgtgttgagagtgtagcacagaagttggaataaacctctcaaactgattttgatgtgcaaccaaggtcgggaaccaccaaggaagagtttttatgcataaagattcctatactctatcctagaactaatacatatgaatctctgggaatggagtataagactcggatttgaaaaggtgtccttagttattctaaggactgagcagtttggatactggtttgttagagtaaaatggttaggtacctagtatcaacctagccatctaaccttatattaacaactaggaaaataaagggttggagcctctgtgtttctttgctgaaaaatctgctgctattcttagttctatgaaaacaaattcaaaattcggttattatcaccttaaaagtacaaaacctatagatattgaaaatgcaattatttttctacaggcatagttaaaatgagtttgtatatattataaatcagtttctttataagtcatttatttagataaattttgttatactgacatgattcactaattttctaaatataaatggttcagctctcagttatttttaaactaaagagctgtgttatacttattatttctaattggcttttatgatgttttaggtttcttttgaatcccgtgtccttcaagtgctttccaactttgagaagaagaaattgaccacccggactatggaactgtgcgtaacagctttgaaagtgtatttaaaaattaaatctgtatgcctttaaatcagtgaattggaaatatattacatgtattttaatgactttcctcaaatacaataaattgttttctttccaatggaatggtgtttgtattttttctttacctggtttaacacatgtaggagaacataactagatgattacatcaaattctttttaaggcaattttataatatattttatttatgattacaaaaactgccttttaaaagttcttgcctggatatgaatgcagtttcacattttttaaattgtaatcttgctttttgtaattattttatatttgtctggcttcgagttttattgggttttagttttttggaagtgggggatttatcccaatttagaaatttgtatccttgccgtaatacagtctaccatttttgttctcccagatctttcatctgtcagaacatcactcaaaggtgaaaatatttcccacataaaattattcttttcctttagtgaaattagttccagctgtatatacgtaggaaaacattcttctttttattcgattcattcctataggtacgttcctgggtctgtgattacacctttaccttagaggcactgcccaaaaagactcaagtcttgtgtaaaaatgctgttgtggatcatagcttcctaccttttacagcatcgtgaggcagggagagtaagaacattagagacaggaattagaggcatggagaaatgaaccctggagcatcccaatggtgagatataaaatagttcaagaactattaaagaagactaaggaggaatagctagaagctaaatgaagaaagtatctcaaataggaaggagtgatcaaatattttagctgtgttgatgagttaggaaagatgagtttttggattaagcactgggtagagcaacctttgggacattgacgttgaccaacttggtggatatcaggagtaagaggaggtactcaagagaatgttggagaggaatttaatatagtgagtattgaagacaacacttaaggagtcttgctttcaaggggatgtgagaaatgggttgttaatggagggtaatatagcatcaaaaagctgtttattttaagatcgatgatatagcaggtttctatgctaatgggactgattcagtagacagaaaaagcataatgcaggaaacagagggatattgatgaagacatagacctggtaaaaaaatagaaggcttggttttaaagataggcacacaaacagctaattactaacagtaggatgtacgtcagattatggaggtccagatgtttgtagttcagtagataggaggagcatgtcaaatttttgtgatattttctcagtgaaataggaagcaagctcataaaaagggaagaaatcacgaaggattaaggaaggaaaaagagatgtaaaatgaatagctaggaatgtacaaaagtaaacaaactcttggcaatctgtggtttatttaagtggtattagtcaatgtggtttcgtgttcttttccagttcagttcagcagaggcgctatcactgaataagtacagaattcagtttaactaaaggtgagatttctctaggtgaataaaacagtcagtgatgagatgttcatacatttaggagaatgattataaaagagggatatggaaagtaatctgggttaaggagtgaagtgagaaaataaagaaggttgagacagtggaaaatggtatcatcaattgtagattgcagtgtggttgacgatgcaatggagttctcgaggtaggaactagaaatttgggagatttagataagagtgggttgattgaaattggaagtattagaggataatagtatataatagtactaagtatagtatactaagtatagtagcatagtgctaagtatatactatcttgtgagtataagttttaggatgtgaagatgggggtagcatagaggcaaagtgatggaaggagatgagttaaaggaattgagaacctaggagactgaaaggattatctaaatgaattttgaaatctcaacaagagctgtgctgagtgcttgtagtcattattttatgtttactactctgtgagaagacagcacttccttttgtgagtaatggaaagttctttcatgtgtcaattgtaagatactttattaggttcaattatctttagtaatgcatactaaaaaatagtgagctcagtgggattattcagtagatatgtgagctaaccccctctgtcagacacctaagaggtagaactgatggtcttcaagaggaatagagacttctcatcctaagtgtgtaagctgtgaaatatcccaccctatgttttctgaaaacaaacgttatatagagtgtccacataaaagctaacaggaaatctcacacacacacagacacacacacacacacacacacacacaaaacattgaaaaacttcaggaaagatataccctgtacccaacatgaacgaggtcaaagcaatgaagaaaaagctaggaaatcaaataagtctagaacaactgtgactaatatataaagatttgaggtggttatatccatttaaatggtatcaattagaaaggaaaaaaagaggccaggcacagtggctcatttctgtaacgccagtactttgggaggccaacacaggcaaatcaacctgtggtcaggggttagagacaagcctggccaacacggtgagaccccgtctctactaaaaatacaaaaatatttgctggacttggtgtcgcgtgcctgtgctcccagctgcttgggaggctgaggcaggagaattgttttgacccagaaggggagattgcagtgagctgagattgcgccattgcattccagcctgggtgatggagtaacatccaaaaaaaggtattttacataagaaattttattttatttttctgtaaattataaaatagcacttaatatggaatttatataccagaatctttgaatatccaaaatttaagatgagagcaattttgagaaacttttcaaagcttaggaaaaggtaactacataaaacaccattatgtgttatttatgggtacattagatgaagtaagtcacaaaaacacgcatagaaatgatcatataaacttgcaagaaattgaatgtcttgctattgaaggaaaggttgaggtgtaagagattgaggttgagtgtgagaagctctgtatatattgtatttttcttaaaaatatatatttaaactcacatttcttgtttttcaaatgttcactccaatgaaaattcttttacttttcctgttagaatttttatttccactctcacatatgcagtgtactattgttcagaaatattagtgatcctccttgcaaatgaatactcccatcctgctgattttcagaaggtccaagtgatttgctttggctgtgaaatgtaagcagaaagagtgttattttggggacttcccgattgcaaaacaacatagtatcgcaacttttgacatagcatttacgttgcattagtcattataagtaatctgagatgatgtaaaggttatatggaaatactacattttatataaaggactcgagtagttattgctttaagtatccatggtgggtcctggaaccaattcctcatggatatggaggcacaaggaaccactgtagttaaacaaataatcactttaaaacttaaaaccttttgcatggtgagtacagtcatgcaccgcatatatgatggtggtatagttaagtttattatgccatacatttattggaagtttcctatgtttaaatgtattgagatacacagctacactgctttacagttgcctatagtattcagtaaaataacatgctttacaggtttgtagcctaggaggaataggctatgcaatctaggttaatgaagtccattctgtgatatttgcacagtggcttaattacctaagggctttgtcttcagaacatactcctgtcattaaggaatgcatgagtgtagttggacaaaaaataataatgcaggcatacctttggcactgtcctaattcttaccaacatccatgattgcttaaatttgcactggaaagacttcaaaaaacagtgatatattaggacagtatatttccaatacatgacaaatgataacaacataagaactcaaaacattcaataagaaagaacataacaattaaagcaaaactagatgggaaaaggaagaagcaaatttcaagagaaaactcaaaaggccaaaaagtgtgaaatgatgttcagccttgctagtaattgggaaaaacacaaatctctttttttttttttttttttttttgagagggagtcaccctctgtcgccaacactggagtgcattggggcgatctgggctcactgcaagctctgcctcccaagttcacaccaccattctcctgcctcagcctccaaagtagctgggactacaggggcccgccaccatgcctggttaattttttgtgtttttcgtagagacagggtttcaccatgttagccaggatggtctccatctcctgacctcgtgatctgcctgcctcaacttcccaatgttctgggattacagctgtgagccaccgtgtctggcccaaatcatttttaatctattaggcaaaaattagagctatgataatattcatttttggtgggagtgtggcaaaaggtactataacagaatgctactagagagtaaactttgatacatttgtaagggcaattttgcataatatgaaaatttaaaaatatgcttccagtttcacatacgtttatctagcatacagaattacccatgtgtaaacatgtatacagatgttcattataacacttcttataaaaacaaaatatttgcaaatattcatatgaacaagtgcatacatatgatcttagtccagttagaattttctgttttatttcaatcctttaaaagactcaacttctgattctatataaacaattcaaaaaagaatgtgttttccctatgtgcatttggtcaggtaaattaaaaaatacacctcatgctagcctcacaaaactggaataagccttgggaaagaagttgtccttgaagcttgtatctgacattgtagcaggacgagccgcagaaaaaacctctcagacactgagttgtagaaggaagggctttattcagctgggagcattagccagctactgtctctaaatctgagctcctggagtgcacaatttctgtcctttttaagggctcacaacactaaagatttcacatgaaagctttgtgattgatttgagcaagcgaggtatacatgacaaggactacttgccccggtggtcagggagaaacagaatatggaagagagtttcacaatgttcttctacacaatatctggaatctgtgaatcacatcggcttctaaatcataagtggatgttcaactactgggtttaggccaaccaggcccaggtctgtttttgggcctggcgccgggctgcctgtctttggttttatttccttgttgtttttactgaatagaaaacaatgtaaaacaagaggagagggtctttctcctctctcattttctttctttgagactttcactcatttttattagtgggagctgtcacttttatgatttatgttcttctgtgcaatagattgatagccatttatattgtatgcttgtgctgaaggcttttggtgaaataagggagagacgaagttttttatgatttggagaaacacaggtatcagacaagggagcagtaagcaggttcctattactattattacctctattataagagttttaaatcctcctattgctgggaactactttctaaacatggctcctggattgagtctgtgccagccttgcacgagtacatgtgccagttttgttatatccttaagtatatgctcaactacttgttctttatcatctatgtgtaggcaacatgtttcgtcagattctctcgccaggcaagaacagtcaaggcttgttgggttttattagtaataatttctaaagcagcttgtaaccatatgagcatgtagataggggttggatatcctcatgagccatcttgtacttaagtggcgggtccatagtattgtatgattctttcaggggtgcattcatcatctttctaaccacttatggctatgcttcattttgcctgggaagcatagactgggaagcctacaagttcaactgtttttatgggcagtaagaagaaagatggcttcatggtgccaattacacagccacacgcccactggtcaggcagcttagcataagctttgtgtctacatatctagcataacctagtgggggccgtccagtcctggtggaattctggatgggcctaaacagtctgcaactttggaaatttgctgaatgcatttctttctgtgtaattggaactgtaccatgtaactgtttttgtggcaccattatacaggttttgcctaagacaaataagccgccttacgggatgagtaaatccttttctttctctagctacgcattactgtctaataattgtgacttttagaaactaaaaattgtcggggttgttcttttgggatggaattcgtgaggaactccatctgtaggaactaattcttgggcttcttatggccattgatctcctgttacagtccttccacaaacatcacatgaaatgacttgtagagactgggctacatgtttggctaattgcaaaaacaaatttttagtttttttcagaaatttcaggtataggcacattgaattcatcatagaaagtgtgaaatacttgtcctggtgagcgtttttgaacttcttcttttatcaggatgcttacactagaatctagtccttttctatcaatgcctaatgttatatattttcttttattccactttggatctgaggggtttgtgatgatcaattttaaagggttgcagctcccacttgtgcaagaggggctgacttttcttttttggagccaaacaggatcttttttatctttcttctaagtagcctaactgacgcaataccactattgacacatcgaacataaatatggttcttgacagatgtacttattttctgtgtgtaatttttcccaaatttagagaaatgcatcttatcctctgctgtttagtattaatagtggcacgagcatcaaattttaaagttacatttgtggggactcttctttcttctgttctagctatcactttacttgtgttacttagagaaggaccagttcttagtcttacttcgaagactgtgatcatgggggtttagaggggtcatagcacacatcgggctggtcacttcctggattacatacttagtactgggtgttattatacaaacaggttctgtttggagttcttaggcattcataatagctgtaaaataaaacgatcatcttaacttgtccttcttcagtgtcctgatgtatgcactgaaggcagtcctctgtgtgggaagaggtagtggaagcttttaccacacaggtccatgttataaggacaataagtcctacgacgattttcctcatgctttggccatgtgtagtctagtcagcttcgtggtgtgattggagcagggcttgtcattttcttcaaggtcacttttcagggattgtccaagtttggtttggcctcctaggtctcagcggctgcaggcttcatgaggctgtggtgaatctaggctgggattccttctacattgacagctgtgggagtggtcaggttaattgtctggggtcctttccactgtggccacagcggagccacgttccagtccttgatccacacaatgtcacctggagaaaaagggtgaactggggagaatcagctgcctgggcacctctcatttactcaagttgagatagtctgagtaattttccctaaggcctgtagctgccgctgtaatgcaatctcacctaactcttggggagtacctggaagccctcccagtatgggaggaggcctatgatacagaatttcaaagggggagtatgctgttctcttagaaggggtacacttaattttaaacaatactataggaaggacttgtgtctattttaaatttgtttcttgacatactttccagaaactttttctgatagttcgattcatttgctgcactttccggaactctaaggttggtaaacggcatgtaacttctatgaaattcttaatacctttgccgtcttctgtatcaagtcagcaacaaatgctggcctattatttgagccaattcgtagaggcagtccaaacctagggatgaaattttgaagaagtacacaggttacttcaggagctttttcagttcatgttggataagcctccacctacttagagtaagtaaacactagaaccagtaaatacttgttacttctacatttaggcatttctgtgaagtccacttgaagatcttcaaaatgagctgctccagaggcttctattccccgaggtacagaggggccttgcttcgcattgtgctgtccacaggtaaggcatcactgcgctactgttgtagcaacagctggcaagggtgagatgtagaaatactggcctaacagcttttcaagtgattcttggcctcaatgggtagtttcacatacagtcagcatgactgtatagcagcggtggcactgctattcttccatctggtaactttatgtatctttcctttattgtttgtcctctctctgtctgaaaaaattctttttcctctttagaataagttggcaccagatcaagcatttgaaggagtagcagggctgtgactgatgtctggtaaggagtagatgctgcttttcctgcctctgtgtctgctcagggctttccttggcaaaccgaagcggaaactcgctgatatcccctgcaatgcatgaatgccaccttttggggtttctacactgcttctaatcattgtagaatttcttgctgacattttatgtcttttcctctagaattttttccttatacaatgctccacatacttgaagggttagaaaggcatatcaagaatcagtatagatgtttacaatcttaggttcactgagttccagagcccgagttagaggaatgagttctgctttttgggctgaagtgctctgaggcaatggcttagcttcaacaacatcatctaagtttactactgcatatcctgcacacctttctctttgcgggttgatgaagctgcttctgtccatgtagaactcctaatctaccaatgcctatggctggtctcaaagatctggtctgctagaatagacatagtccaacacctctacacagttatgtttaacagggctgtctgatactgggagcaaagtggcaggatttaaagaattacagacttctatggttatacattgattttcacataacaagctttggtgtttagttaatgtagcatttgttagccaatggtgtcttttggtgttccttagagttacattagagtcagcttgggctgacataagtttttcttttaacttataagtcttgttgttgtagagacctctatttaaaaggctctcggtcaccccctttataactccattcaatgctttggctaacaccacaaagtttggaatctgcagtctgcaaaaatctcacagctcctaaatgttctcttatttgcctcctggttttaggttctggtaagctgcagatgacctgctttcttgctgaccatagactgcactccccttttcaaatagtgaatcctaggtagtgtacctgctgtctgcagatctgagctttctttttgggcactttatatccacagtcctccaggtgtcgaagcagggcacccgtcctttttgcacacctgactgccatggagtgtcctagcagaaggtcatctacatactggagcaggatgcaacctaggtctttagcaggaaacatttggaggtctccaaccgaggcctccccaaagatggtgggggactttttgaacctttgggaaagtcgagtctaagtgtactgaatggtgacatctgactccggatcttcctactgaaaggcaaacagcttttggctctcaggaactagcctgatgtgaagaaggcatctttcaagtcctgtacgggtcgatagtctttggtccttggtttagggacaggtaggaggtgggtgttccatggagactggcaaggaactagaattccagaggcttttaagcatataagatgagtctctattcctttaaaggcttccctgggaacaggatacggcttttgtccaattggctaggtcgtaggctaaacttctatgagtacgggggcttgattgattgccagcctcagaggattgtcctccatctctactcagagccgtcactcagctggagccacttttatttcctgagctggctcagttagcaaaagtctccactcttcttcctgggggactggaagggccatgatgactcctgtttctggcaactccagctgtaaagtgccttgttttgtcaaggaaatggtggctcttaacttgctaagcaagtctcttctcaacaaaggcaagggacagtcagacatatacagaaatggataaatcactttgtgtcctcccactgagcagttgcgcggtagacagaagtcctgcttggtagagactcctgttgctctaattctatcaatggtctttatagatgagggggccactggagtgcttactactgagtgttcggctcttgtatccactaaaaacttaatgtccttgccccttattgtcatcctgaccatgggctccttgggggcatttgagcctgttccccttaattctagcagcccctcagctagattgaacaaaatcctttcatcttggtttgaggtctttggctctgcatcactctgattttctttgagttggggacatttatctttctaatgtcctatttctttacagtaggcacattagtcatgctgcaaatgtgagtgattggacagggcattcctcccagaacccccttttttctgccttttcaggagaattcctctaattgtcacagccagcaaactagcgtttcacctggcctggcgttcgccctccttacggctttcttggccgcttgttgcatctctatttacaaatacttcattagctctttccagtaactgcaaggttttcattcctgcaaacctagcctgtttttgcaattttctctggatatcttctgcactctgaataactaaggccgtattaatcaacggctgattttcaggactctccagatcgaaaggagtgtacatgcaataggcctcacacggtctttgatagaactgggctgggctttcctcctttccttggatgacttcagaaactttatttacattggtacccttttgagccccttttttcaacctttcaattaatgcctctcggtaccctcttagcctttccatatctggtccttcatttggatcctattgagggtccgttcctggcagctgaattcttatgtattcttggggactttgataattggctgggatgtgctcctccagccatttaactgttgcctgcagcacctgttgccttttatgtgttttaaagaggtacatgagtagctggtggcaatcagcctaagtaggattctgagtctggataattctttgaagcaagtcaattagggcttgaggcttttcagtgtaagatggagtgttatttttccagttgagtagttcagcagaggtaaaagggtgatacacaaaagcatgcctttctaccgtatgtctgacctcatctgtcctagtatatcgctgctctctcagggcatttgaattcccgtcttgggccgttaagcgggctgccagggaagtggattttcccgcagtttcacttttgttcttgtctactctgggtggtctaggggctgtgggctcaggagaagggggcctccccactggataaggggttgagggcactgttggtgccatctcctgccttgagtcctcgagctctgggtcaaacagaactttaggtgctggcttctcttggccggtggagcgagaactttcctgaaataaatgtccctttgctactactactgctgctgcctgtccttttaccactgtagaggatctaaaactagctgtaactaggaatctctatatggaaattgatatgggtgcaggcacaccatgagcgatcaggccaagcttccgctcaggtggagtggggcaagttgaaaagacttgtcttactaagtttcagatgtctggactccaagtgccagttccttcctggtgttcagccactgtgttaatcctccgcggggatcactgctctggcgaggcgttcaaccggggccatttcctacctgggagcgctctttggatcccatccctcaggctggccagagtccctggcagcctgagggatgccccggccttactccacaaggcatgcctaatctgcctaaggagctgcctcggccgtccatcagttatcttgcttccaggtcagggaaccaagaaatgtagcaggacaagcggcagacaaaactctcagacaccgagttgtagaaggaagggtgttattcacctgggagcatcggatagctactgtctcaaaatccgagctccccaagtgcacaatttctgtcccttttaagggcacacaacactaaagatgtcacatgaaagggtcgtgattgatttgaacaagccagggatatgcgacaaggactacatgcacccgtggtcagggagaaacagaatatggaagggagtttcacaatgttcttctatacaatgtctggaatctatgaataacatcggcttctaaatcataagttgatttgtaactactgggtttaggccaaccaggcccaggcctggttttgtgcctttgattttgcttccttgttgtttttactgaatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaatagctaagtgtgtttcttttcttacatatacagtaatagttacatatcattaattttaaataaaagctctaattagtaaaaagaggtttaagacacttgatagtatgaaatacaattccaggttacacataagttatttattttggcaaaaggatgactcaaaaattttaaaactaggcaacaatctttactcattaagaggtaagacttagctttccaaacagtttgtctcctgtctactcttttctctccttggcattctaccaacaaggcaaaccaaatatttcattattcttctctattacatgaaaaatctgtacaagggaaggaaagccaaattttacccttacataggtttcaaaagaatcctttttccataggcaacatttacatttttatgcctttttataatcttttaccacaaacacatttaagtgttcctacacaccttgcatgtaaatttatttttagttgtcttatttacatatttttatggtcaatcttagcaatttttaactttaatgtaaacctggtaagttgttttaattatgtactagatgcagataaagtctgactttttccattctagttagggcatggttaatttcatatgtccccaggccttaccaagttgtaaagtaggcagcctacaaccttgaaatatttagcaagccttttatctaatttatgtgatttaaacctgctatttacatattgatgatatttgcattttccaatttgatctttaaaacagtttttatttcttagagtttaaaaacacataaactaaaaggcattacggttttaactttcctctaaaatatttgatttaagtgcttatttttatttaaggcaatcaattggtcctcgttacagacatcacacacaacacatatattgctacacagacaaacagaagaagatccagtagctctaagatttcttctcgtcccatttcctaattgcattactggcttcccagtagagccctttaagaacagggatagcaaaccacgaagtttctagggcctaatcaacttgtatagctgtaagacaaaaacagattttgagcaggattgatcagcctctagattctgggattccatgaggaaaacagaggtttctcccaaaatggaatccatcatgcattttctgtttttcccaaaacgtttcaggccaccagaagttatcttgtgtgcattaagagtggaaagacagagtggagaacagtaattcagtcaatggaaaagttcttttcaagaaaaacacgatccaagaagacaaaaacatgcaggtcttttaaatatacctataacttgaatatccacttttaatcaagctcagcaccctttcagaaaatcctttgacatcttctgtttcctgactttagctaaatcaagcaggtaatatttctggcttttgaattttaccaaaggtaacatcacaggggaaactaaaaactctccgttaggttataagttcaccgttagtatacaagatattttataagtggtggtaagcagcttttaccagatctagaacctttaaagtcagttgagagaaaggaagatttcagaaaggcagttagagtttttcatggcggagcacgagatgattaaacgtcacacagttgttaactggaaagtattcatcacccaggctgggattgaacctgggtcaccattgtaaaaaggcaacggctgaaaagtggtactaccacatggttacaggttatgcttaaggacataaaacaagtcggagacatgcagcaaagtttgttactgaccagtttatgagggtgtcttgaacagtgagctcaaggagtctcaggcctggattccattccaaggtaccctctgtctgactttttcttctattttctctccttttcctgagcctcctcctagtacgtcttatgaaagactgaggtggctactcttagaaggttttctaaggtgccttctagtcctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagagttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatattgattaaaaatcttaaatcaatatttgaaagttcttaaatatggatttgagtttcttaaagtagtcaaacttgttaacttctgtccctaagagatctaaattcctattttaaatgaaattcaattagctacatgtctacaagaaaaggcatatattactcttttattcagatcactctcgtaaaaaaattacctgagtagcatcattgtagttctcgatatctccacttccagttttacatttaccatcattgaaatcccatccagaatatgggactgctggaaagtccctacttccagggttgaagtaacttccacaggtactgcttgttcctgcactcacagcgttaccacacatatgattaattacagcatccacataaatacgaacctagaaaacaaagtttctacttcagtgtgacttacagagaggtagaaatttaaagcattattgatgcaagtttatagtatgttaataaaactccaaaatatttcatg

SEQ ID NO: 530 - DNA, 10321 bp, Homo sapiens
tgattaaagaggtttataatcagttactttaataggtgatatagtatagtccaaactctgagctcagggtgcagagaacacaagcacagacaacaaatgcatatatagatgcattggattacaacaaagttaaaagcttccaaacaacaaaggaaataatatacagaatgggagaaaataaggggttcatatccaaaatatataaggtgctaaaataaatcaataataaaaagtaaaacaaataaaaataccctgatttgaaaatgaaagaaggacctgaatagatatttctcaaaagaagatctaaaagtggccaccattttaataaaaaatattcaacatcactaatcatcagggaaatgcaaattgaaaccacaatgagatatcacttcactcctgctagaatagttacaattaaaaagacaaaagttaacaaactttggcaaggatatggagaaaaggtaacccttgcacacagttggtgagaacgtaaattgaaacagccattgtggagaacagtttggagatttttcaaaaaataaaaatagaactaccatatgatttggcaatcccaccactgggtatatatacgtatttatatgttgaagagatatctgcacttccatgtttattgcagcataattcacagtagccaagacatagacccaacctgtgaccattggtgaaagaatggattttaaaaggtgttatatgtacacaatggagtacttatcagccataataaagaatgaaatactgtcatttgtggcaatatggatgaacctggaggagaggacattatgttaagtgaaataagccaggtatagaaagaaaaattccacttgacctttctcatatgtgaaatctgaaaaagttgatcccataaaagcagagagtagactggtagctaccagaggatggggatatggagccatgggagggtttggaaaatgctggccaaatgatacaaaatgacagaaggaagaagttcaagaggtccattgtagagcatggcaattatagttaatggccatatattgtattcttgaaaaggaagtgatcagcaaacctaaaatactgatgaactgtaaaacttattatgaagagtcactctacatgacaagaaaaaatataaaataaaaaaaatgacaactgggcacagtcgctcatgcctgtaatcctgaaactttggaaggctgaggctggaagattgcttgggcccaggagttcgagagaagcatgggcaacatagcttgctctctacaaaaaaataaaaaatagcttactctggtggcatttgcctgtagtcctatctactcaagaggctgagaagggaagggagaatcacttgagcccaggaagtctagtctaccttgatctgtgattgcaccactgcacctcagcctgggtgacagagcaagatcctgtctctaaataaataaataaacagaagagtaaagtctatttttgatgggagaaattttggtacttctttaatctttgtactcactattggtttattcaggttttcatgtaattcgtgattcagtataggtaagttgtatttttccaagaatgtatccattttttctaggttttccaatttgttagcatataggaattcatagtagtctctaacaatcttttgtatttttgtgttatttattgtaatgtcttctttttatctgtgattttgcttatatgtgtcttcttccttcttatactagataaatgtttgttcatctttttaaaaatattatttttgatttgttgatcttttgtaatattttaatctcactttcatttatttctgctctaatctttactatttcttttcttttactaattttgggattggtttgcatttacttctctacatttcttgaggtgcatcattaagtttttatgtgaagtctttttgttgtcttaggcatttattgtgatattcttcttattcctgctttatctatatttcatatgtattgttatgttttgatttcctttttatgcattttaagacattttaaatttttcttttttaatttttttatcaatacataagtcattcagtagcatgttgttttattcccatgtatttgtacagtttccatcattcctcttgttactgatttctagttttagtccattatggtcagaaaagatacttgatatgatttcaatttttttgaatctcttgaaattgttttgtgtctttacatatcatctatcctgaagatattccatgtgttgatgagaagattgtttattctgcagcagtttgagtgaaatgttctggaaatgtcagcttgatccatttggtctggagcatagtttaactttgatgtttccttgttggttttctgcctgaataatctaaacattgctgaaaatggggttttgaagtcccctattatcattgcattgaagtgtatctttcccttgagatctattaaatttgctttacatatttgggtgttgtggtattagtacacaaacatttactatcattatatcctgttactgaattgatgcttttatcattatacagtgaacttcgctcacgctttttacagtttttgatttaatgtctattttatataatgtaagcatagctactcctgctcttttttggttttcattttcatagaatatatatttccacctcttcaatttcaatctatgtatgtctttataggtaaagtggattgtttgtaggcaccatacagtcagatttagctttttgttcttttttaattcattcagccacaaaattttaattggaacatttagtctatttatattcagtgttgttattggtaggtaaggacttgatactgccattttgttactagatgttctgtagctcctctcttcctctcttcacttcttactgttttcctttcctgttaagttatttcctctggtggtatttttaattccttaagttttacttttagggtatttattatagtttttggcattgtggttgtcattaactttacaaaaacatcttatagctatcagaagtacctcaaaataccttttttttttttttgagtcagggtctcactctgttgcctagactagtctgcagttgcacaatcatggctcactgcagactcgatttcccaggtctcaagtgatcctcccagctcagcctcctgagtagctgagactccaggcatgtgttaccatgcctgactaattttttgtagagatagggtctcactttgttgcccatgctggtcattaactcttaggctcaagtgatcctcctgccttggcctctcaaagagcttggattatagggatgagccacttcacctggccctcaaaacagctattttcagttcctggctgagagggcaaacctcacctctccaggtctggtgactggcactttatttaatcaattttgttaggttatatttccttgaatattttggatacttggaggcatgcatcaataactaggcattgaaaaattaggtatttatttcagtcttgccttgtttgtacctgtccttcttcagagagtcttccagtagtttaaaggggactgcctgttgagctccgtaagccagtggttgctcttggcattttagcactaaagggtgccctgaccctaggtttgttgtaagtcttgcaaactgctagctcaccaaccctccaacctgaacatggaaaagacatgggacagttccctgggtttctaggcaaagtcctttgctctcctcccactttccctcaagcagaaggattctctctctactctgtactttctgtagttgaagaaggggtgacgcaggccaccagtagcctctgcagcttgtaaggtactgaattgcacccaaagcctctttgaccagcacagtgtaggggcttggtcaaggcctgtagtcactgctgcctgactgacactgacacttattcaaggcctgaggctacgttaggcagccagtagagaagagggccagaactccggtttgttctgccaggatggtggattcccttctggcccaggatggatctagaagtgccaagcagctcacttggttctgtcctttgttgttttaagtggtggggttcgtacttgggtcttaggcaaagcccctgtactcttccctcttcttttcccaacacagggattctctctccacactgcactgcctggggttgggggaggagtgatctgggcactctaatggctgccacaacttacatgatgctaggttgctccccaagccatcagcctcccagaccagtgcagtactgggacttgcccaaagccatggtcactacagcctgcttgccactgaaatttactgagggcccgaggccactgtagtcaggtagtggtgaagcaggctgggactcaggtttctgttacttgggtggcagattcctctctggtgcagagacgtctaaatgcctcttctgtgggcgccagtctagaatcaaggactatgagggccctgccctgtgttgtattccactgtggcagggccagcactaagttccaatgcaaattcccacactcacttccctttccctccccaagcagccagtttctctctccacactgctctccctggtatcaagaaggggtggtttagacaatgtggtactgtcctttctaaagtcttcaattcccctcttttggttattataccaaaatcaggcactgtgattaattttgttcttttgaatgtgatttttaatctgtatagttattcaatgtaatgtacctgcaaggtaacaatcactgggaacttctaattggccatcatgatctggctcctcatttgtctatatttttgtttgtttgtttgtttgcttttgtggttttttttttgggggggggctgggcttttggtgttatatttaaaaaatttttgccaaaaccagttttaaggatcttttcccctatattttattcttgaagttttacagtttcatgttatatttaagtctttaatattcctaggatgtacccacaaacattaaaaattaaaaaaaaacatgggatgtaaggatgatttgatatacatggataataaatatgacccatctcattaacagaatgaaggacaaaatcaatataattatctcaatagacgcagataaagggtttcacaaaattcaacattcttttatgataaaaactctcaacatattaggtatagaaaaaatgtacctcaagataataaggattatatatgacaatcctacagctaacatactcaatggtgaaaaatgaaaagcttttcctttttaagatcaggaacaacacaaggctgcccacactcaccatttctattcagcatagtactggaaattctagccagagaatttaggcaagaaaaataaataaaatacatccaaactggaaaggaagctaaactgtctctattgcagatgacgtaatcttacacaaagaaaaccctaaagactccactaaaccaaaaaataaagtcagtgaagttgtaggatacaaactcaacatacaaaaatcagtaccattcctatacactaacaaagaactatccacaaaaggaattaagaaaacaaccccatttgcgatagcataaaaaagaataaaaggcttaggagtaaatttaaccaaataagtaaaaaatttgtacactggaaatcataaggcactgatgaaagaaattgaagaacacataaaaaaatgaaaaattatccaatgtttatggattagaagaattattattgttaaaatgttcatgctatccaaaatgatccacagatttaatgtaattcctgtaaaaatttcaatggcatttttcacaaaagtagaaaagagaatcctaaaatttatgtaaaatcacaaaagacttaaaatagatgaaacaatattaaaaaaaccccagcaaacctagagactttatacctcctgatttcaaactacattacaaagttacagtaataaaaataatatggtacttgtataacaagacacataatagagaggccagaataaacctattcatatatggttatctaatttttgacaatggtgtgaagaacacacaatcaggaaataaacagtgttgagaaaactggatattcataagtgaaggattaaaattggacctttgtctcatacaatacacaaaaaaaaaactcaaaaaagattaaagacttaaatgtaagaactgaaatcataaaactcctaaaagaaaactgtggagagaaaagctccttgtttacaaccttaatgggaaaacactatttttcaccattaagtgtaatgtcagctgtggaatttcatagatgcaatttatgaagttgaggaatttttccttgattcctatttttctcagatttttttctcataaataaatgttgaatttcaccaaatgccttttttctggaagaacaggtatgatcattttattttttcttctttacaccgttcatattatggattattctaattttaaaatgttgaaccaaacttacaatgctagaataaactccacctggtcatggcgtaaattccttttatatgtagctgaattctgttttctcgtgtgtgtgtgtgtgtgtgtgtgtgcgtgtgtgtacctgtgtgtgtgtgcatgctttttcttctggtttgttatcagggtaacagtagattgaaaaaaaaatgaactggaagtgttattttctgggaaatagtctgtaaaattattgttaattcttattcaaatatttgttagaattttccagtgaaatcatctgggcctgaagatttatttggagtttttaaaattgcaaccacaaggttttcaataattatagggctagtcaatgatataatctgtggtcgtttgtgctttttaagaaattggtcagcttaatatgagttgtcaaatataagtgtatagagttttcacggtattcctaagtatcctcttaattaattctttatatccacgagttgtgtagtgctaaccactgttaagagttctgactttggtaatttgtctactgtctttttttcttgctagaatattgccaattttatttttattgttattattttcaaagaactaggtttttgttcattgatttaatctattgtttctcttttttcaacttcattgatttttgctattatctttatgttttcttcatttgtgtgggttaattttgctttttaaagatctttgaggagggagcatattattggtttgattttttttttcttttctacatgaaagttttttgtgctatacatttctctctcagcactgcttaaatcatgttccacaatttttgatatttgtgttttcatttttactcatttctgggttttttaaaaaattggtcttgggactttgtctttaacctatagtaagtttcgaagtgtgtggtttggtttccaagtgtttggaaatttccttgtcattctagtattgctttcttgtatgcttgaattatggtcatagaatatactctgtgtgatcattattagttgagatttgtctcatgactcttaatatgctctatttcatgtgacccgggggccctgaaaatgtctgtgcatttggttaaagagttctatatatatatattgactagatcatgtttgttgacattgttgtgttcctctatatccttgctgacttttcatcaagttgttctagcaactgacgacagaggtgttgaaatatccatcaatagttgtgaattattttagttcttccttcaattctattaaattttgcttacaatatcctgcagcccagttgtttggtgcatgcacatttaaggctaatatgtgttcatgttgtattaatcctttatcattatagtaagtgactgtctctgttagatttctttgctctgaattctgctttaccttatactaatatagtcactacttctttttctgaaattaatgtttacctattatgtcattttccagtctttacttctacctaacctatattgttatatttgaagtgtgtttttttcatagacagcttacataggagctaagttttcttgatctattccaccaatgtctgtattttaattagtgtatgtataccatctctatttaaagtaatgattaacattataaaacttaagtacaatgctttcttttgtttctgttttccattctctttctcttttttcctatcctcttgagttacttgaatagttttttttcctaaaacatatatatatttatttatttattattattatactttaagttttagggtacatgtgcacaatgtgcaggttagttacatatgtatccatgtgccatgctggtgcgctgcacccactaactcgtcatctagcattaggtatatctcccaatgctatcccacccccctccccccaccccacaacagtccccagagtgtgatgttccccttcctgtgtccatgtgttctcattgttcaattcccacctatgagtgagaatatgccaccgcatattgttgttcctttccatgtttagcgcttccttcaggagctcttttagggcaggcctggtggtgacaaattctctcagcatttgcttgtctgtaaagtattttatttctccttcacttatgaagcttagtttggctggatatgaaattctgggttgaaaattcttttctttaagaatgttgaatattggccccactctcttctggcttgtagagtttctgccgagacatctgcttttagtctgatgggcttccctttgaggttaacctgacccttctctctggctgcccttaactttttttccttcatttcaactttggtgaatctgacaattatgtgtcttgttgttgcccttctcgaggagtatctttgtggcgttctctgtatttcctgaatctgaatgttggcctgccttgctagattgtggaagttctcctggataatatcctgcagagtgttttccaacttggttccattctccccatcactttcaggtacaccaatcagacatagatttggtcttttcacatagtcccatatttcttggaggctttgcttgtttctttttattcttttttctctaaactacccttctcacttcctttcattcatttcatcttccatcgctgataccctttcttccagttgatcgcatcggctcctgaggcttctgcattcttcacgtagttctcaagacttggttttcagctccatcagctcctttaagcacttctctgtattggttattctagttatacattcttctaaggctccacctctgggggcagggcacagacaaacaaaaagacagcagtaacctctgcagacttaaatgtccctgtctgacagatttgaagagagcagtggttctcccagcacgcagctggagatctgagaacgggcagactgcctcctcaagtgggtacctgacctctgacccccgagcagcctaactgggaggcaccccccagcaggggcagactgacacctcacacggccaggtagtccaacagacctgcagctgagggtcctgtctgttagaaggaaaactaaccagcagaaaggacatccacaccaaaaacccatctgtacttcaccatcatcaaagaccaaaagtagataaaaccacaaagatggggaaaaaacagagcagaaaaactggaaactctaaaaagcagagcacctctcctcctccaaaggaacgcagttcctcaccagcaacgaaacaaagctggatggagaatgactttgacgagctgagagaagaaggcttcagatgatcaaattactctgagctacgggaggacattcaaagcaaaggcaaagaagttgaaaactttgaaaaaaatttaaagagttacttgaatagtttttaaaattccatttttatgtatctatagtaatgttgattatatctgtgtatatattttattgatggctttacatacatatatatatacacacatacatatatatatacatatatatacatatatatatgtatatatatacacatacatatatatatatatatatatatatatatatacacacatacatatatatatatatcttatcacagtccactggggtcaatattttaccagttcccatagaaacattacctccctttacttcattttatctctgccatttataatataattgtgtttaatatttcctctaaattccttttgaacagtgaaaatagtgttatattttcacttcacctgtcaaaatactttggaaaactgtagtgaaaagaaaaagttttatatttatcatatttttcctttttccattctttcttaattcctgttattccataattccttcatttatctctttccttcctt

SEQ ID NO: 531 - DNA, 24399 bp, Homo sapiens
ccctgcattcctctacatgagaaattgttttttgtaaacaatcctcactgttaacatgtgtctgatggcccacagagctgcagtgagttaacagaaaggcatagtgtaggaaagaggctgcccatgaaaactccacctcttactcttcctccttttgtggatgtgcttgtcaggagatcacaggctttgttctgctcctcactgccttagagctgagagagacaagagtactagcggaggaactcacaggtttcctggctactatgactggttggataacgctatataattcaggagatgcggataagggcacatttaaaatttctataaatattttgttataacatttaatacatttttaatgaatattttggtctctatgttccttagtgttttgtcttttaaaattgatccagaacacagttttgttgcattatagtaaactctctttctccccctaattaaagcccaccaattttaaagtcattattttttgtcatattcacttatattttgtattttgtattcagtacacagatacactttaattttagtatttgtcatatattgaattataataaaggtattacaaaaatggtcattaaatatattccatagctagaaatcaatatttcccagaagtgcagtctttttcaagattgattctttcaattgagtagcttattttagatattcaaacagtgatggaatttagatatcattatccaaaatagaagcaaactgaattactatatcgataaacagtctggtagctataaaatgaaataaatggggaaaataatatatattgaagaatgttttttataatttatttttctctatagatagaatgataattcaatcactggctttatctgtcataaaatatcccattaaaggcttcaagtatggtacccaaagttttatgtctacatcaataatatgatatactaaataactcttaggggaaaaagccatttttcatgtatttctttttatgactgtaaaactgatagtgagtattttatagtcaacttgttttgaaaagcattgaaatttttttgaagatttaggtacttaggaagcacctagtcataatacaactggctttttgttaaaaaggtttgcttatatacattacaccctagtgttataagtttttccttggtcttcattaattaagagaaagaagtggagggattagttcaatttaaatgccacaaacctccattttttttaaatggagaaatacaatttcatgttcaatcaggtaaaacagtgaaggttaaatgataaactcacagccactaaaaagattttagtgtaagtacaatagcaataattttaaaattgccaaaatcatttctggtatacattttaatcgcagatatcttatatccttaagctatttaaataatttcatgcatcttaactgaattattaactttaatgaacaaaaattcccgcaggaaaataaagtaatattttgagaagaaaaataattccagcacaaaaaactatgaaaactcaatccaaggaatattcagagattagaaactgagtaaggttgttaattccatctctttccccctttaaggcaatacttgaacaaaactttcaaaaaactgaagtaaaatcatttagagagagcatactgccatcactggaagaatcaacctcaagtgaataatcttacaaattttgaaacatggtgtatacaaaaaaaaaacatgcaaaacaaaaacgaatcttaaggccaaaatgtggcatccaccatatcaacatagtaaaacaattaaatttaaaagtcaccataattttggaactaaggaacaagaatgtctatggaaccattggtgtttttgatctcttctgtctttcctctgtcttttccttcttttcttatctggaaaaatatattttatcttctgaaatacttacaggtgctttgaatcacttatataataataatgaagtatgtgtttcaaaatcactgaactttttcagaggaggagttatagaaataactcaaattttacctttcagattttattgcattaataataattgacattactaagccaaatagacacagctttcacagaatcaatcttcacaattattaaaatattttatatttttggctatctacactaacataatgaaaacaacttcaatgcatcacatacttaaattataccacacactgtgctaagcacagttttcaacatttatactaacctttctatgtcccatcacataggtgttattctccccttttctgttaaataattaaaatgcagaggaattacttaatagattttaaagtctcacagttgcctaaaagacggggagggagaatcaggattcaacaaggatatggctgatctctttctcttcttattttatcactattcatttgtggaacaaggtaatggagaaatagtgtgtatttacagccagacttttccatctgccttagccgcctatatttttcacctttaatgtcttgagattccatgccggagttattttccacaatgtgctcaggcatccactcctttttcaacctgttcatgccttccttatctactcttacttgggtactgattctcatcaattctgaatctttatttgtgaatttgacccagttggctctctggatttgcttgcattcagaattattcctgaattataactcaattatcctctgtttatattataaatgtttacatatatctagttatttggatgacctcaatctcctaagaaagtgtagttttacttgtttattcatttaacaaacagttaatgagaacctactgtaaatgaagggcaattatagccatggggatgaagtggtgaccaatatagctaaggcccttgtttttaagaaaatatgcaagaactacagataataaaccaatagccaaataattaaaataatttcacatgataataaatactgtgataaatgcaaatgtgatcatgaaatagtagagaacaatggggttcactgggcactattgatgaaagagtagtcaggaaaaggcctccctgaaaaaataacatttgggtagaaaaatgtgaacatcattgtgactgtgactgaaaaatagagcatgaggaagaaatgagaagaggcctgagtttaaagctagcattcacagatcattgatgtaaggctttataaaccacagggagacacttagattttattttaagtggccagttctaggtttcagttaaaacagtgaatatgaactgatccaagattttaaaagagctgtgtggagaagggaccatttgagtattgtaggaaaaaaaaaatgatgatgtcttggtctagagatgctggagagcaggtgaggaaagagtttgatatggggtatattctggtgtaaaaaattgacatgacttgctgaaagactgggctggcaggttaaggaaagacaagacatcctctaaggctagaaaatgaacaagctgccttttgtgacaccataccattgctgcgaatcagtccggctatctttggtaaacccattaagaaactgacaagaaagcagggattcactcttttcctggctttcctattcaattttatacagtgttcttcattataagaaaaagtaacatctatttctaaatgcaattgtgggacatgatttgaagtcaaacacaaaattaaatatatgtaattctgggatattttttaattttaggaaaatgtcatatgttgcttattacacattatctcctaaaaggtcatttaagtatattcaaaatgctgaatcacacatcactatgaaaaagccatatttttaaggctaaatagtatttaacaatatcacacaatagcttccttaatttttacaaatgtatacatttacatatacaaagaaagtgacatttattcatttctactttcttattatgcatcataattatttgtttatcactttttccgtaccagctacaatctgtatcaactacaatcagaaacactaaaatggtgctaacaatgtaattgtagttatttaatatgtactcaaagaaatctttccttctctctataactagaattgatgaccccacctgtgacttcttattattcatgtattttaaataaaagtttccatatcaccttacagagtgcaacaattatgtcaaatatttgtatgttattagattgtaaatagctttcatgcagaaacttagtaatattcatctgcttcacaactgtgaacactgtgtgggacatttaataatcactcaaaatgtgttgggtaaatgaatgaatgagttctataactattcatactgtagctatcttgattaattaacacttttctgcgatttatacggttttaggcacaagcacacacaggcacaaataggttcaaagagccgtacctcccagagtagcagatagcaagaaatgtgtcccatatttcttgataaggttttctgtgatttgctgaagggtaggtcgacgtcccaaaagtcttatgttgcggaagaattcaggggcaagaggcagaggagagccaaggaaatttcttctctcaactgcaaggttatttactttccagcggccaaactccctgaaaagcaaatttatttttattcataaatgcataatctatctgaatgttttcatttgagttcacttggtagctggggtcagtacattacaatgtctcttgcttgtaatactaggttgtgtgctatgagtaggagaagcaatatttataatttatttaactggagtgaatactctaaaaccaagtcatgtaaaggaaaaataagccacctaaagtgtacagcttccactgagatttttttccccaagaaaatatattttcataaaaacgactttattatgcctagaatatgaatatagagttactaaacagtaacaaaacaacttaagggcaatttttttcattttctaaggtatattggaaaaaaagaatgatttatattcatcaccctaatgattccctttctctattcactttagagtgggaacataaaaaacctcaggaatattaaggagacgcagaactttaaaaacaacaaaaaagaaatcagttttcttctttttttttttaataatcatggtttacaacatatttggaaacccaaattcagctattgcaatttctcaagatgcaaagtgattttatggatgaatttggccaagttagaaaaatgaaagatatgtctataaaagatttatacattttttaaagaatgtatacatttacattgagataaaatcaatctgataataaattagaaaagaattatagcaaactgcatctgataatttttctgagaagtggtccaataaaattctcaaatatcacccacagggaagaacactcttcattaggcttaatacttcaaagtgtgttaattcatatttataaaataatcaaataaaatgttaattaaacactttatacacatgtgcaatctttatttctatttttctccaaaaaatgcttgctatgtgccaggatcagtgcatgataagagattcatctactgatgagacccacactgtccatctgcaagtagccttctccttttggagaaatgtttaggaataaataaaataaagacagaaaattaaattttttaaagttttaaattctgatatgtactgagagatacacatacagaccactttgatgagaaatatgactatatgaagtgtggccatattttacattacatggccaaggagggtaactctgccgagacaacaattaggcaatatgtgaaaaaataataataaattgcttggtgcaaggaggcaggaaaaggactgaagcagaataatgaggaacagtgtacatacttccaggacaaagggacatgacactgacagtttctaactatggatatttagtacttgtggcacatatttgacaaacagcccatttttgtcactaattatatgatcagaatcacttttgaatctagggaagactttggcctgaacataaattagaaattctttcatctttgagaaattcttgctatctcctgtaagaatcagctcatctaaagttttaattagtgtttttcctcgaagggttctcaaacttcagcacctatcagaatcacctggaaacttcacaacagagattctgattcattaggtattagataggagttagaatctgcattttaaacagacatgctagtgctgctcttctggtgaccatactttgaataaaacaaccgatctacataatttgctatattgtctttcagatctcttcaaagtgtcatcttttcagtaaatatagggcttttataggctgaatttattataatgttccctcaaaatagagtaagaatgtctttatctttccaaacctaagttgatatcaataaatttttatgttagtcacttctacaataaatttacttaaatctgaattgtaggtacataatgtatgtatatgtataatatataaaatatataatattaaatataggatatataaataaaaatttaaacattgacaaaagatcatttgaaatcaaatatttaagtcctaaatttgatgatatatctcaggatatatagtaatacaaaacttctaagaagttatttttataccatgatcaaaataatagttgctcattaattccaaaatttataggcttatgctcaaacatttaattttttaactcctgaaaaatgcttgtaatttaatcaatagagtaacataacttgaccttaaagctgtgacatgtatttttcagtggtttacagtgctaaatttgttaactcaaatgtatttatagattaagatacaatctaagtgaaataattagactaaaaaatccaagatgattgattcaatggtaatattttatatcctgtataaatgctttctaaaatgctgaaagattttcgatacatgactgagagtaaacacatgctagaaaagtgcaattctatgttttttaacaattagtaaatatgcaaatataaatccatgatctattctgacctgatgtatttatgacttccttcattttgttcctcttaaataagaacaatagacatattacaaaacaactaaaacaaattatgtatcttatgaaatcaatttataaggctctataatactgtagaatcagctattcaaagaaaatattgtttactctttattatcaactaatattattgtccatgttgctggcaatacagatgaacataagaaaatctatgacctcgagggctcaaaaattatacaaagataaaatatgaatgaataaattgccattcaaaggctttagagtatttttctgtgtaaaaatacaattgtatagtagcttagttagcccaactcctctacccatttatcattgttctttgatatgaatggatctaatccaactcactttggatatgttttctctgaatagcctaagaaggcttcctggacaactttccagagagcttccttcagctatcaggtactttttactcactcaatatgttaaatttgtagtctcacttcaccttctaatatttcaaatgataaaacactttgacaccccatctattaatctattatctctgtcatgcaaaaaacaaaaagaaagaaactctttggggatatcaccaaactaaaactaattaaataactaaataattatagttattgttaataactaaagaaaaatattttcttaatttcaagaaacttaatcttccagttttctccccatattttcatataaagaataaagcaaaatactacaccattgtgtatatccaaaagaataaagcaaaatactacaccattttgtatatccaacaaggttagtttgtgtagacaacataaatttcaaattgaaatctaagagagctcttatttcctctccacatttggtttgtactgtcgtgaaatatgatcactgttataatctttataaagtttttctggaaactgagataaaacaacaaaataatcctaagaagtggtgataagagcgctttaagtaaagacagtcatctctggagaaccacactgtgagtagtaaacattagatatgaatcgaaattcccagtgtccctttttcccgaatacaagataagacattactgatgacattttaagtcaccgtggccatgtggcttactttgacagatgaattgtgagcatgtatgtataacctggtccataagcccggacattgattagcaactataatcagaattgctatggtccacatatatccctaacgcttaacaggatgaacaagtgaatgaactgaaagtaaattttgtcatgtaaagtcatcaagattatgggaggctgaggtgggagaatcacttgaacccaggaggcggaggtggcagtgaaccgagatcatgccactgccctccagcaaagattatgggattatttgatttgcttattttctagtagtataatctagtatatcattattgatgtaaagttttttgactctgggaaatcttaggaaggtaataaggagctaatgtctgtatataaattggaatctaaggggtgagggtttgttttttttttccttgtttcctgaagacaagattcacctcagttacaactagatcatgcattcattaaatgttggaaaaacaaagcaatggagcgctgaattaaaaacatgctgttggatgtaattaccataatgagaacattttacctaaggcatctcaggatttcatccagatgctttatgtttatattaaataagaacattgttgtatctaactaagtgttgtattctacttggagccttcacagaacgtaactatcttcccatcataacgtttgcaagtctttcaattaaataggcacaatcgttagtttaatgtaactcagtccttttcaagacaccactgtgatatagaacacacatatgggctgtaaccagtttaaccagaacattactttgaaaatatttttggggatcatactctaaggagcctctatttgtttattagagttttatgtttgtctgctaaaaactctgatgtgcaatcatctactatgtatgtccatacaacgttaatttttctacaatgtttattataattttatccctactcagctcataaaaaggctagaaaataagaatgacatcatcaaatttcagttaaatgctggtcacataattgccacattgccattaacctttcttattagcatttaaatatatacaaatacacaaatgtactcagtatatttaaaagatattaactgtcatgatttctttaaaagtacacacatatgtttggctttcccaaaacacagaatttgccactcttcatattagaaattttggattaaataccaatgaaaaagaaacccaaaatatattgacaaaagcagatgatgcagtagctgaaaagatttacctttaactgttaatttccattaaatgaagttgtctaaagtcctaaatgctattattacattacttttcacattactatatttgttggctagtaattttatcaataaccattaaaattttcagacacaatagaatcttaaaataaatatattacctaagcattcatgtctactggaacaaattcaaaacaaaaatcacaaattaacttgccaaactttaataacgataacattctaattacatctgtaaaatcatatggatcttaagaaatggcactaatgtcaatattggctccccataattttattgagaaactgtgatatataaaattgactttaaaagcatttttactggctgggcacagtggctcatgcctgtaatccaagcactttgggaggctgaggcggacggatcacttcaggtcaggagttcgagaccagcctggccaacatggtgaaaccctgtctctactaaaaaaaaaaagaaaaaaaaaatagccgactgtggtggtgtgtgcctgtaatcccagctactcaggaggctgaggcaggaggatcacttgacctgggaggcagaggttgcagtgagccaaaattgtgccactgtaccccagcctgggccgcagagcgagactccatctcaaaaaacaaaaacaaaaacattcttaccatatagcttcaacatctcacaaatgacactgttttccatttggctggtaaaaggaaaatgttttaaatggcctggatgcctgtaccactgaagctagtgtttataaaacagctaaatgctcagcaattggcaagataaaaaagtccactctccctttagccccttgatacatcaaactttttaaaataaatttaatagtagtagagtttaattttttttttaagcttgggaaaaatttttggatgatgctggaaatttagcagaatgaatctattccaataaaatactggggataaaagtccaatcacaaatacaacttatgtaaagtgtttatatgtaggatttctgataagcactgattaatgactgttgtattttgaaaaagctgccaaactcaaagtagactacagaagacaattggcatgactgcaacaaaaacaattgccatctcagtagaacaacaagaattaattgtagctgtaacctcatgactatcattgaaacaaaaaagatgaaggtggggctattgagaaatttttaaaggatggtctggtttatggctagttatgcacacttcagatttttaaaatatgttatattttagggctttgaaattactgaaaataatttaattttatgttacatagttttaaatcactttcatagcttaatagggttttatgcaaactaagagaaatacaacacaaatgcaggtatatatgataatacagaaattgattaagcttgtttaaattaaatcacattttgaacacttgttagcaaaagctttctgtaaaaacatacaaacatgctgttaatgatcttctcatttgaataaaggaaaatatgtaagaattttgcttaaattttgctttctaaagtttgaaagtatagtttaatttctatcacaaatattatatcaacttatcaaaattactccttaattacattcatataataatacagattaggtaactattgataagtgtagacaagtcaagaggcatagacatatctgagctaaaataaaataaaataaaatatttagtctgtttctgataaaaagagatacatggaatgtttttattttagcatttatacttacagaagtaattcattatcttcattaatagatataaatatttgcatttgtgaatatattttattattttagatagggaattttaatttttaaaaggaaatggaatttggagtgaaacaactgaagtttcaaatcctatactcaccaatttaattcacaaaatgtaaagctttcagaatttttgcaagttcataacctcggtgatataaacacacctcatctatgatcatgggtgtaataaaactgatacaggagacattttgaagtaaaatttgtaaaacttaactacagtagtacagataacatggattacttcttagtaatttttggtacatgtaaatttgtgaagtgggttttttgtgccaggatgttaatttttaaaaatgtataaatattattgattaaggtaatgcgattttgtggaattaataagtaaaaatttacaaaagaatttataaataaaatcacttaaagaatatgcaccacaccagtgttgttccaggtatagactaataagtttaatgctcataaagataggtaaatgtgaaatagatatctgttaatgaaaaaataatgtttgctgacaatttcttcaattatttaggcaacatttccactgagatttctttatgatgatacaacatctaccttaaattaaacattggatttttttttaaaccatggattatgtgaaggtaactaaccaattatatatctgagattacaataaattacaacttcacatattgcttcatttcaagttacatgaagtaagaaggcaaaatgaaggattttttaaagaataactgcatttctagtgacaataaatataaattgcccatcttttaaagaaaatttttcataataaagatgagttttgaataataactcaattcagtagaatttacatttttcctgaaatatgtcttaaaatgtcttaaagggaattccttttaaaatgttagatgatttttcccacatagttgaggcaaatgaaaatgtgttgctgcaggtcataggctttaatatacaaataatttatttcaacatgctcttaattttatgtctttcatatatacatcagatagggagactgaatatggtactttgtgacaaaataaattttcagaaaaagtataaacttaagtttacaaggtataaattttttattccccaaattataacctttcagtatgaatcaggcttgattgttagaatacaattttacacacaaacactttataaaatattaacaggtaatttcatctttctgtggataccactgtcttgtatggattacaaattgaaacttgttatctagcaagcacttggtcttaccatcttcttttggggatttatataatataaacttcttaaatattacctgcttcatatgaacttcaaagacactaacaatatgtgggaactgccatcttttctgctctaccatacctgtctccaattaattcaggtcctcttgttatatgcactcgtggcacaattttcttttccttctgtgaacttacttgtgtcactctttgattcatgtttcatgtagatgtgaattattttttcttataaccattgtatttttaagactcaaatgaatgacccatagtagtcactcattaaatacactcggaatcatgaaatgagtaaatattctcatgtgagctaaaatgaaatagctacctaagtatgaaaaagaatgaggtttcctactagttagtatacaccctgactaaagttcacagaaaatcaaactcagtagaggaatatatttctcaattatcctctttgagtgttcatgtgactagggcaaattaaaagttaactatttgctctaaactgagaaacactaaccgtatgtaaaaacctactcccactgatatctaaaatatatgtttggaagtttagaaatatgctatcatttcctgctagggcagtaaaatgtatagttgtggtactccaagcatcttacggttaatacactttgagaacagcaatccagatatttcagctataaaaagatttttaatttctctaatctatgccagccataaggcaggggaagcacattgatatagacaaattcagttttcatcttttatgggcgaaataaatatatttgactagttttctcctataaactttaaaatgtaatttttcactgattagcagtcaataagtttatacgtttggtaggcaaaaacaactttcatactagtgttcattaaacattttctgccagataacttttacttcatcattgaaattgaaatgataatttaattagacttgtttctaagcgatcaacctatgaattttaaactatggcactgaggtgtgtgctctttttatctccttgtgataaatgagagaagattgttagaaataaattctccgaggctgtatatctagcaagaatttgaatctagggggtgagacctcaaacttaatgacattaactcatttacagattgatagcaactttgattgaaaggtggctgttactggtaatgtatatctgtgagtgtttgtgtgtgtgtgtgcacgtgtgtgtgtgtgtatttgtgggaagcatggaggatgcatgggagagacagaaaaagatatggagtatagagagagagaggaaagagaagaaacagacaaggttgagagaagtttatccattaaatggggaggaatgtgagaaatactaatatatatcaaacagaagcaaaaagccaagtatagattaatcttttattgtcctgactagctacccaggaaacagagaatgtaaacctctacatggtagaaggacttaaagggcctttgagagtatttcacatttcttaaaagatgaattgtaggaagtgaatgattaaagaggtttataatcagttactttaataggtgatatagtatagtccaaactctgagctcagggtgcagagaacacaagcacagacaacaaatgcatatatagatgcattggattacaacaaagttaaaagcttccaaacaacaaaggaaataatatacagaatgggagaaaataaggggttcatatccaaaatatataaggtgctaaaataaatcaataataaaaagtaaaacaaataaaaataccctgatttgaaaatgaaagaaggacctgaatagatatttctcaaaagaagatctaaaagtggccaccattttaataaaaaatattcaacatcactaatcatcagggaaatgcaaattgaaaccacaatgagatatcacttcactcctgctagaatagttacaattaaaaagacaaaagttaacaaactttggcaaggatatggagaaaaggtaacccttgcacacagttggtgagaacgtaaattgaaacagccattgtggagaacagtttggagatttttcaaaaaataaaaatagaactaccatatgatttggcaatcccaccactgggtatatatacgtatttatatgttgaagagatatctgcacttccatgtttattgcagcataattcacagtagccaagacatagacccaacctgtgaccattggtgaaagaatggattttaaaaggtgttatatgtacacaatggagtacttatcagccataataaagaatgaaatactgtcatttgtggcaatatggatgaacctggaggagaggacattatgttaagtgaaataagccaggtatagaaagaaaaattccacttgacctttctcatatgtgaaatctgaaaaagttgatcccataaaagcagagagtagactggtagctaccagaggatggggatatggagccatgggagggtttggaaaatgctggccaaatgatacaaaatgacagaaggaagaagttcaagaggtccattgtagagcatggcaattatagttaatggccatatattgtattcttgaaaaggaagtgatcagcaaacctaaaatactgatgaactgtaaaacttattatgaagagtcactctacatgacaagaaaaaatataaaataaaaaaaatgacaactgggcacagtcgctcatgcctgtaatcctgaaactttggaaggctgaggctggaagattgcttgggcccaggagttcgagagaagcatgggcaacatagcttgctctctacaaaaaaataaaaaatagcttactctggtggcatttgcctgtagtcctatctactcaagaggctgagaagggaagggagaatcacttgagcccaggaagtctagtctaccttgatctgtgattgcaccactgcacctcagcctgggtgacagagcaagatcctgtctctaaataaataaataaacagaagagtaaagtctatttttgatgggagaaattttggtacttctttaatctttgtactcactattggtttattcaggttttcatgtaattcgtgattcagtataggtaagttgtatttttccaagaatgtatccattttttctaggttttccaatttgttagcatataggaattcatagtagtctctaacaatcttttgtatttttgtgttatttattgtaatgtcttctttttatctgtgattttgcttatatgtgtcttcttccttcttatactagataaatgtttgttcatctttttaaaaatattatttttgatttgttgatcttttgtaatattttaatctcactttcatttatttctgctctaatctttactatttcttttcttttactaattttgggattggtttgcatttacttctctacatttcttgaggtgcatcattaagtttttatgtgaagtctttttgttgtcttaggcatttattgtgatattcttcttattcctgctttatctatatttcatatgtattgttatgttttgatttcctttttatgcattttaagacattttaaatttttcttttttaatttttttatcaatacataagtcattcagtagcatgttgttttattcccatgtatttgtacagtttccatcattcctcttgttactgatttctagttttagtccattatggtcagaaaagatacttgatatgatttcaatttttttgaatctcttgaaattgttttgtgtctttacatatcatctatcctgaagatattccatgtgttgatgagaagattgtttattctgcagcagtttgagtgaaatgttctggaaatgtcagcttgatccatttggtctggagcatagtttaactttgatgtttccttgttggttttctgcctgaataatctaaacattgctgaaaatggggttttgaagtcccctattatcattgcattgaagtgtatctttcccttgagatctattaaatttgctttacatatttgggtgttgtggtattagtacacaaacatttactatcattatatcctgttactgaattgatgcttttatcattatacagtgaacttcgctcacgctttttacagtttttgatttaatgtctattttatataatgtaagcatagctactcctgctcttttttggttttcattttcatagaatatatatttccacctcttcaatttcaatctatgtatgtctttataggtaaagtggattgtttgtaggcaccatacagtcagatttagctttttgttcttttttaattcattcagccacaaaattttaattggaacatttagtctatttatattcagtgttgttattggtaggtaaggacttgatactgccattttgttactagatgttctgtagctcctctcttcctctcttcacttcttactgttttcctttcctgttaagttatttcctctggtggtatttttaattccttaagttttacttttagggtatttattatagtttttggcattgtggttgtcattaactttacaaaaacatcttatagctatcagaagtacctcaaaataccttttttttttttttgagtcagggtctcactctgttgcctagactagtctgcagttgcacaatcatggctcactgcagactcgatttcccaggtctcaagtgatcctcccagctcagcctcctgagtagctgagactccaggcatgtgttaccatgcctgactaattttttgtagagatagggtctcactttgttgcccatgctggtcattaactcttaggctcaagtgatcctcctgccttggcctctcaaagagcttggattatagggatgagccacttcacctggccctcaaaacagctattttcagttcctggctgagagggcaaacctcacctctccaggtctggtgactggcactttatttaatcaattttgttaggttatatttccttgaatattttggatacttggaggcatgcatcaataactaggcattgaaaaattaggtatttatttcagtcttgccttgtttgtacctgtccttcttcagagagtcttccagtagtttaaaggggactgcctgttgagctccgtaagccagtggttgctcttggcattttagcactaaagggtgccctgaccctaggtttgttgtaagtcttgcaaactgctagctcaccaaccctccaacctgaacatggaaaagacatgggacagttccctgggtttctaggcaaagtcctttgctctcctcccactttccctcaagcagaaggattctctctctactctgtactttctgtagttgaagaaggggtgacgcaggccaccagtagcctctgcagcttgtaaggtactgaattgcacccaaagcctctttgaccagcacagtgtaggggcttggtcaaggcctgtagtcactgctgcctgactgacactgacacttattcaaggcctgaggctacgttaggcagccagtagagaagagggccagaactccggtttgttctgccaggatggtggattcccttctggcccaggatggatctagaagtgccaagcagctcacttggttctgtcctttgttgttttaagtggtggggttcgtacttgggtcttaggcaaagcccctgtactcttccctcttcttttcccaacacagggattctctctccacactgcactgcctggggttgggggaggagtgatctgggcactctaatggctgccacaacttacatgatgctaggttgctccccaagccatcagcctcccagaccagtgcagtactgggacttgcccaaagccatggtcactacagcctgcttgccactgaaatttactgagggcccgaggccactgtagtcaggtagtggtgaagcaggctgggactcaggtttctgttacttgggtggcagattcctctctggtgcagagacgtctaaatgcctcttctgtgggcgccagtctagaatcaaggactatgagggccctgccctgtgttgtattccactgtggcagggccagcactaagttccaatgcaaattcccacactcacttccctttccctccccaagcagccagtttctctctccacactgctctccctggtatcaagaaggggtggtttagacaatgtggtactgtcctttctaaagtcttcaattcccctcttttggttattataccaaaatcaggcactgtgattaattttgttcttttgaatgtgatttttaatctgtatagttattcaatgtaatgtacctgcaaggtaacaatcactgggaacttctaattggccatcatgatctggctcctcatttgtctatatttttgtttgtttgtttgtttgcttttgtggttttttttttgggggggggctgggcttttggtgttatatttaaaaaatttttgccaaaaccagttttaaggatcttttcccctatattttattcttgaagttttacagtttcatgttatatttaagtctttaatattcctaggatgtacccacaaacattaaaaattaaaaaaaaacatgggatgtaaggatgatttgatatacatggataataaatatgacccatctcattaacagaatgaaggacaaaatcaatataattatctcaatagacgcagataaagggtttcacaaaattcaacattcttttatgataaaaactctcaacatattaggtatagaaaaaatgtacctcaagataataaggattatatatgacaatcctacagctaacatactcaatggtgaaaaatgaaaagcttttcctttttaagatcaggaacaacacaaggctgcccacactcaccatttctattcagcatagtactggaaattctagccagagaatttaggcaagaaaaataaataaaatacatccaaactggaaaggaagctaaactgtctctattgcagatgacgtaatcttacacaaagaaaaccctaaagactccactaaaccaaaaaataaagtcagtgaagttgtaggatacaaactcaacatacaaaaatcagtaccattcctatacactaacaaagaactatccacaaaaggaattaagaaaacaaccccatttgcgatagcataaaaaagaataaaaggcttaggagtaaatttaaccaaataagtaaaaaatttgtacactggaaatcataaggcactgatgaaagaaattgaagaacacataaaaaaatgaaaaattatccaatgtttatggattagaagaattattattgttaaaatgttcatgctatccaaaatgatccacagatttaatgtaattcctgtaaaaatttcaatggcatttttcacaaaagtagaaaagagaatcctaaaatttatgtaaaatcacaaaagacttaaaatagatgaaacaatattaaaaaaaccccagcaaacctagagactttatacctcctgatttcaaactacattacaaagttacagtaataaaaataatatggtacttgtataacaagacacataatagagaggccagaataaacctattcatatatggttatctaatttttgacaatggtgtgaagaacacacaatcaggaaataaacagtgttgagaaaactggatattcataagtgaaggattaaaattggacctttgtctcatacaatacacaaaaaaaaaactcaaaaaagattaaagacttaaatgtaagaactgaaatcataaaactcctaaaagaaaactgtggagagaaaagctccttgtttacaaccttaatgggaaaacactatttttcaccattaagtgtaatgtcagctgtggaatttcatagatgcaatttatgaagttgaggaatttttccttgattcctatttttctcagatttttttctcataaataaatgttgaatttcaccaaatgccttttttctggaagaacaggtatgatcattttattttttcttctttacaccgttcatattatggattattctaattttaaaatgttgaaccaaacttacaatgctagaataaactccacctggtcatggcgtaaattccttttatatgtagctgaattctgttttctcgtgtgtgtgtgtgtgtgtgtgtgtgcgtgtgtgtacctgtgtgtgtgtgcatgctttttcttctggtttgttatcagggtaacagtagattgaaaaaaaaatgaactggaagtgttattttctgggaaatagtctgtaaaattattgttaattcttattcaaatatttgttagaattttccagtgaaatcatctgggcctgaagatttatttggagtttttaaaattgcaaccacaaggttttcaataattatagggctagtcaatgatataatctgtggtcgtttgtgctttttaagaaattggtcagcttaatatgagttgtcaaatataagtgtatagagttttcacggtattcctaagtatcctcttaattaattctttatatccacgagttgtgtagtgctaaccactgttaagagttctgactttggtaatttgtctactgtctttttttcttgctagaatattgccaattttatttttattgttattattttcaaagaactaggtttttgttcattgatttaatctattgtttctcttttttcaacttcattgatttttgctattatctttatgttttcttcatttgtgtgggttaattttgctttttaaagatctttgaggagggagcatattattggtttgattttttttttcttttctacatgaaagttttttgtgctatacatttctctctcagcactgcttaaatcatgttccacaatttttgatatttgtgttttcatttttactcatttctgggttttttaaaaaattggtcttgggactttgtctttaacctatagtaagtttcgaagtgtgtggtttggtttccaagtgtttggaaatttccttgtcattctagtattgctttcttgtatgcttgaattatggtcatagaatatactctgtgtgatcattattagttgagatttgtctcatgactcttaatatgctctatttcatgtgacccgggggccctgaaaatgtctgtgcatttggttaaagagttctatatatatatattgactagatcatgtttgttgacattgttgtgttcctctatatccttgctgacttttcatcaagttgttctagcaactgacgacagaggtgttgaaatatccatcaatagttgtgaattattttagttcttccttcaattctattaaattttgcttacaatatcctgcagcccagttgtttggtgcatgcacatttaaggctaatatgtgttcatgttgtattaatcctttatcattatagtaagtgactgtctctgttagatttctttgctctgaattctgctttaccttatactaatatagtcactacttctttttctgaaattaatgtttacctattatgtcattttccagtctttacttctacctaacctatattgttatatttgaagtgtgtttttttcatagacagcttacataggagctaagttttcttgatctattccaccaatgtctgtattttaattagtgtatgtataccatctctatttaaagtaatgattaacattataaaacttaagtacaatgctttcttttgtttctgttttccattctctttctcttttttcctatcctcttgagttacttgaatagttttttttcctaaaacatatatatatttatttatttattattattatactttaagttttagggtacatgtgcacaatgtgcaggttagttacatatgtatccatgtgccatgctggtgcgctgcacccactaactcgtcatctagcattaggtatatctcccaatgctatcccacccccctccccccaccccacaacagtccccagagtgtgatgttccccttcctgtgtccatgtgttctcattgttcaattcccacctatgagtgagaatatgccaccgcatattgttgttcctttccatgtttagcgcttccttcaggagctcttttagggcaggcctggtggtgacaaattctctcagcatttgcttgtctgtaaagtattttatttctccttcacttatgaagcttagtttggctggatatgaaattctgggttgaaaattcttttctttaagaatgttgaatattggccccactctcttctggcttgtagagtttctgccgagacatctgcttttagtctgatgggcttccctttgaggttaacctgacccttctctctggctgcccttaactttttttccttcatttcaactttggtgaatctgacaattatgtgtcttgttgttgcccttctcgaggagtatctttgtggcgttctctgtatttcctgaatctgaatgttggcctgccttgctagattgtggaagttctcctggataatatcctgcagagtgttttccaacttggttccattctccccatcactttcaggtacaccaatcagacatagatttggtcttttcacatagtcccatatttcttggaggctttgcttgtttctttttattcttttttctctaaactacccttctcacttcctttcattcatttcatcttccatcgctgataccctttcttccagttgatcgcatcggctcctgaggcttctgcattcttcacgtagttctcaagacttggttttcagctccatcagctcctttaagcacttctctgtattggttattctagttatacattcttctaaggctccacctctgggggcagggcacagacaaacaaaaagacagcagtaacctctgcagacttaaatgtccctgtctgacagatttgaagagagcagtggttctcccagcacgcagctggagatctgagaacgggcagactgcctcctcaagtgggtacctgacctctgacccccgagcagcctaactgggaggcaccccccagcaggggcagactgacacctcacacggccaggtagtccaacagacctgcagctgagggtcctgtctgttagaaggaaaactaaccagcagaaaggacatccacaccaaaaacccatctgtacttcaccatcatcaaagaccaaaagtagataaaaccacaaagatggggaaaaaacagagcagaaaaactggaaactctaaaaagcagagcacctctcctcctccaaaggaacgcagttcctcaccagcaacgaaacaaagctggatggagaatgactttgacgagctgagagaagaaggcttcagatgatcaaattactctgagctacgggaggacattcaaagcaaaggcaaagaagttgaaaactttgaaaaaaatttaaagagttacttgaatagtttttaaaattccatttttatgtatctatagtaatgttgattatatctgtgtatatattttattgatggctttacatacatatatatatacacacatacatatatatatacatatatatacatatatatatgtatatatatacacatacatatatatatatatatatatatatatatatacacacatacatatatatatatatcttatcacagtccactggggtcaatattttaccagttcccatagaaacattacctccctttacttcattttatctctgccatttataatataattgtgtttaatatttcctctaaattccttttgaacagtgaaaatagtgttatattttcacttcacctgtcaaaatactttggaaaactgtagtgaaaagaaaaagttttatatttatcatatttttcctttttccattctttcttaattcctgttattccataattccttcatttatctctttccttcctt

SEQ ID NO: 532 - DNA, 12613 bp, Homo sapiens
tgctgttataaaagtttctgtgaattaagtggagaaaaatatatgaaacttggtatatggagctaggctttgtctcaaggattttattttatttattttatttttttgagacggagtctcgctctgtcgcccaggctggagtgcagtggcactgtctcagctcactgcaagctccacttcccgccttcacaccattctcctgcctcagcctcctgagtagctgggattacaggcacccgccaccacacctggctaattttttgtatttttagtagagaccacgtttcatcatgttggacaggctggtcttgaactcctgacctcaagtgatccaccagccttggcctcccaaagttttgggattacaggggtgagccactgtgcccagccaaggatattctttttataacattttcaaaaattaaggcatattgtgtatgcaggaaaaaaaatgaagcctatgatttatatttacaattgctttgattttatacaaattaaaatattactgtttatgagaatgagattctaaatgtaaatggaattcacagaatgcataatttttttctcgtttaaagaaatagagtctcgctatatgcctaggctggtcttgaactcctgggctccagccatcctcccatttcagcctcccagagtgttgggattacaggcgtgagccaccacgcctggccttgtacatgttatatagtgaacattttgcacaagattgtttgccaaatgaataatttaaaaaaaatccatttagtgtactttcctttaaatattttcacacctggagttaaaacattgtattttataagatgttattaatataaaaatacttctaattctacttgtggctatgtagaatgtagtagaggacttttgcataagcccagagcctagtttctaaaggtctttagggatttagggaaatcagagggaggtataattctggtctctcgtcgttcagttctttttcattcagttctctcaggcacgactccagccgctcagttttatatttcaactggatgttgacccaattaaaacaattcacaactcctgaagacgaaatactatgagtccctgctttggacacatctgtagtagagtaggaaaagataaatataacccaagtaattgttacagaattttctgaaatatactaatggtaaaaggttttgtagggcttgtactggggaaaaagataattttttagcatgaaccttttaagagcttgtgagtctcaaagagtctttaactgataggtgatatggataatactcccctttgggaggaggtttataatacataaacaacctccccacccttccctcgcagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagcattacaaggttcagtgaattgtctgagatctcataaatacaacctagataagaacccaggtattattattttcagtcttgcaatattattttcctacttgcaatattatcttcactcttcattaagtttgcacagcaaagtaatggaataagttctgggctttaatccttgagtagtttggaattgtaatgtgctacatttgagagagagcccttcattttgaataaaaccttggtactgatcctgatcttctaacttgggttaatgctcttccccttttcattatttttttcatttgtgaaatgaagtagttgcactagatcattttcaattttccttcccacttaaatcaattttaattaaaaaaattgcagatgccttttctcagattagagtacactttttgctccacacaatatctggtttgtaaattagtatgttccgtggagtaaataactttcctgactagccattaacttacttctgattcctgaatccactaatttaactattgttgaaattactaaaggaaatttttctttagcaaatgtaaaacctcgtatcaggtctcaggtttgatgttgtaaagcactctgactctcaggaagactctttttttcccccaacctctcataaacaaatatttcattcattataaaatttcattcattacattttcattcctcagacttaacagtgtttcgtctctgctaagtatagtgttaagcactgacaaaagaactctggacacaacatcatgaacttgctctctgggatcttataatctagttgcagaaacagattggtaaatacatagtatagcacaagtactataatggaggcctgaactgagtgctgtgggggtacacagatgaaggcttctgggagacatcatggcataactagacctggaggatgaataaaactttggccaagtaaatacagagatacacgaaaagcatggataaatggcacaagtaggttcagggatgataaaagtgttagtatgtggagagtgtacaactattttggggaatggggaaacggattaaatttggggccagaccctgaaggatgtggggatcccatcaaagtcttttaagcaggagaatgatcagatgcattttttggtatactacctgggggataggaggaaatggactacagaaggggagatcagtagaaggaagacaagttaggaagcttttcagtcattttcattaaacatgaagcttaatatgtattgttctaggatcaggaatacagcaataaagaaaaaacttggtgtaatgaaacatattttcttgggagagacagaaaataaacatgaaaaacagatgtgttcaatggtgataaagcagaaagggagatggggagtcaagtggatgtggggagggtgtttagggaagcacttatgaaagagtaacatttgagcaaagagccctgatacaagacaacaattcagacccaagacatttgaggaaagagcatccatataaagggagtgggaggtagagaaagcctggaccaggaatgagcctggtatgattgaggaaaacacaagggatttcactcttgagtgacctgggagctaatgggggattaaacagaggagggacaggatcctctatggtatatggtaagtgagtagtatggtaaatgaggtaaatgaatagtaaaaggaactgctgtggtaatttaggtaacagatgatgatggtttaggtgaaaatggttggattgtggatatggtttgattggttttagaaccaataggatttactggtggctggatgtggacaatgagagaatagaatgaaccaaagctattgtaaacgtctagaaatcagatgaggacttgaccaaaggcattggcaatgagaaagtaggcacaattcatgaggtatttcttagcattgatagagttggatataaatatctggaatttttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacactccacagtcttatcattcatagtttcttggcaaactcaccactcaaggtgtgcctcacttatttaggagatctgcctcactagggtagacattttaggtttatgactcttaagttttcacctggacagattggctaccaaaaagaacctcacaggtgggtgaccttgaattcaccaggtcatgccatcagttcagagcggccggagaactctgttctcttgtgcattgatgcccccggagttgtgaaacacagtggccctgctttagtttttttagatttagaaactgatcagtgtcagagcgatcagacacaggaatgttaattcatgttcaaaaataataaccaggctagcatttgtttagcacttgctatgtgacaggtactgttttaagtgctttacatgaattgtttaatcctcacaacaaccctgggaaataggtcctattattaggcaccctttctacagatgaggaaacagacaacagattggtaagtttcccaagatcacaaagtaagtcagtgggaactcaaagtaacctgactccagagcccactctcttatctaagcatatacattcccatcacaagagaacgccagtttattcaagtaaaataaggactagaaatttacatcaagaaatatattctttcaatgtagaatgctgaatggaaaaccaaatttcaatagttgcctactgaacaagatcatgagataacaacaagggagttgattataaatgactagaagttttaaatggcatcggcgctgataaagtgataatctcagctccatgatatacttgtcaagcagttacttacatcaatctgccttctaggatatcctttctcctggttgatgcttatatgatagtgttttgtacctttcctttttcactgcttccattgctgaccaaactactcacctccatatttctggtagatatattttttctcattgcatgttagtatcttaaatttagtcctatcttttgcttgatcctctgggcttgacttcctaatctatgttctggtttatgttttagtttgacagttgagctttctgaggacattcttattcccagtatctttttttgggtggttgggttctgggaggtggtatttgactgctgctgatgtgtaccaaccaagacagtagtcattaagtgactaacaataatgatttcagcagattattattactcttggcaaaaagcaagctttctctattataaatgattttatatttgttttgtttttctttatttgtaatttgagttctagcttaacattaatacttcagataactgttaatacactttcataaatcatacccacattcttgaatggcaaataaataaataatcaagttccgagtagtttctaaagagagtaaacattaaaagtaaacataaaactacataaaaatcaatcacagtctatttataaagttggtatgaaaacaaagatcctagatttggaacactcatgatactcaatattttacatatatcagagtttgtaatttccataacttcatttggtagttagacatatagacagagaagatattaatatattcattttatagtttaggaaacagacttggaagggcaaataacttgtctaagatgactaagcagctgagtgagaaccacagcctatctgtggcattcagtctcagccatctttcccttgcttcataaggatcgttactctggtatcagttgctggactgggattttgggcatttataaatgtttttattttggatatcactgaatcacagacaatttcatcttagttaaaaattcatctgacgtgacacttgtctaaatcttaaaatattaaattttaatgtataaggatgttaataatctttatattttaagagactatgaagtcaagtctggctaacttagatctggaagtttttagctgtggaaagcaattctattgtgtacaggtttcagcctgtgaagggaattcattgaaaatgcatagagatcagaagaactaacacctttcttgcatggatttttcttgattattggcagttaacaataaaatgttattagatcactggtgcttctgtgtggggttgagttttttatgatatctcctgttagacccataagggaggctgtgagttgttttctacatccttggactatataagatcctcttttaaaattatattttatataagcacatgaaaatggaatgaaataatgagttgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatgtgtgtgtatacaaatatgtatacacatacataatatctggagcaaaaatgattatgttgtacagaacttttggaggttttcctccttataaaattctgaagtggtagagttaacattctgcttttaatttatctccaaaaaaatgtgaagaattcccaaataagattttctcatagaagattcatggattttgagtctgagaaaaaaaaggaagaaaaaaaattcatggtataaaataactaaaaattaaatatagtctttagaaatgattttgtttagtataattaatactggtatgacaactgaatgcaattgaaattatgatataaaatttctattctgctttgtatttttcgttaaagtttttataattgtcatctgaaaaaggatttaatattcttcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctcaaattggaaaatgaatattcagatactgagtaaatttttttttttttttgagatggcatctaactctgtcacccaggctggagtgcagtggtgggatcttggctcactgtaacctctgcctcccgggttcaaattattcccctcccttagcctcctgagtagctgggactacaggcccacaacgccacgcccggctaatttttgtattttttggtagagacggggtttcaccatgttggccaggctggtctccaactcccaacctcaagggatctgctggcctcagtcttccaaagtgctggaattacaggtgtgagccactgcacctaaatgacatacttgaaaaaatattctcgggccgtgtgtggtggctcacgcctgtaatctcagcactgtggaaggttgagggtggatcacctgaggtcaggagttcaagaccagcctggctaacatggtgaaaccccatctctactaaaaatacaaaaattagctgggtgtggtggcatgcgcctgtaatcccagctacttgggaggctgaggcaggagaactgcttgaatccaggaggcggaggctgcagtgagcagagattgccccactgcactccagcctgggcgacagagcgagtctccgtctcaaaaaaaaaaaaattctcactttctgttgttgttgtttgtttaatgattaatagatgatttatttaagcaagaatacatagtcatcattgccagacttaatatgacaggttaaatgttggacccaattttccttcccagataagtttttctttcctatccatgtcagttttaaaaacataataccagaagaagaggggcccaattccacacagagctcccaagagtgagtttttaggagtgggtctgaaattaggaaagacacttgctgatcttgcataggtccagggaatcaaggcaggattttcgatgagccctcggcagttagggtaagcaggtttcagccaggctcttaatggtcaaccacttggcttgcgcccgctgggtttccaaaaatatgtcctgttcggctgggttgagggcatagtggccaggggcgaaggagtatactttgggaacgacatcttggcgacccagcgcataactcacttttttttggaaacaaggttggctctgtcttccagactggagtgcagtggcgcaatctcggcgcactgcaacctccgcctcccgagttcgggcgattgtcctgcctcagcctcccaagtagctgggactatgggcgcacaacaccacgcccagctaaattttgcatttttggtagagacggggttttgccatgttgcccaggctagtcttgagcctcctgggctcaagtgatctgcccgctttggccttccaaagtgctgggctcataggcatgacactgtgcctggacagatttttgttatactgtttagatatgatggtaactgaatgatcatgcaatctctgaccatgtgacattcagggataccaaaaatgacttgagatgggccaagggagaattggagaagcatactttggctgaatacttaggccaaagtataatttggaacatttcttttaaaaaatctactcccctatgccccccacttgcagtaccttacaattacagttaatctagtagcagatactggattgggatattaggtatttacagaccaaatgcccattgggatattactaggtaacaggcagtttcactctggttcattgtagattcatccagtaagcatttctagagaactgctatatgaaaatattgtggaaagtatcaactttttaaacttttgatgtcatggcacctagaagattattttctgatactcatattctaagggaattttgttttctgagatttgtttctgtggaatttctagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggcaagctaattcagtttgacttattcatgcaatagtctgtctctgcttatgacataaagtataatatattttaggaatagtgtggttttcttcatgatgtcaaacatacaagcttatggatatatttaaaaattcttaattttctagattaatgttcagcactacttccatcttgcattggatgggggcagataattaataattatcagatattttcttatcaaaaacaaatttgttggaaaaaaaattttttttttgagatggagtcttgttctgtcgcccaggctggaggtgcagtggcacgatctcagctcactgcaagctccacctcccgggttcacgctattgtcctgcctcagcctcccacatagctgggactacaggcgcatgccaccacgcccggctaatttttttgtatttttagtagagacagggtttcactgtgttagccaggatgctctagatctcctgacctcgtgatccgcctgccttggcctcccaaagtactgggattacaggcgtgagccaccgcccccggccgttggaaacattttgaaggaactctttgtaaataaaatacatggcatgcctttctgttttactatacagttgctgatttatcctttagttggttactttgaatcatcattaacatctgttgtcaccataatccctgtgatcactagatgtcatactccattttatgttttattgttgccttggggagactttgagagtatgagaggtgttcatgcagactgctgctgagtgttgcatagagatggaataaagtacaaataccttcaggaacagactccaaacttggtctattccagcttcctttcattttttttttttaaacctattccagataatttttcattggtattctctgaaggaaaataagagaaatttcctcttagaatcccttctccttggatttgtaacctttcccagttcatttctgtggaagtacttgtagtccagcatagtaattctattcagatatgtatagttcagttaagtcacgaagggaaaggaagctttcgttgagggctatctactaggtggtacagtgctaggtaattaactttatctcaatccttaaacaactctgcagtggtaagggtgattaattcatcccattttgtagacaaggaaactgaatgttagagggatggcataatttgttcatgttcatataggtagtactttgggaagcagaatttgaacacagatctttctggttctagagctttgtgttcttctaccttgctatgatgttaagtaattagttttaacatgccacttaagtttaaagccttaagtagtccttttaagaaatcttttgttgctggttattctcatttaacactcctattttaatttccaggttcaggtgacctcactttgccagaaccgtgggtcttcatgaaataagagatttcatttggtttttgttttggtttgcatcctctctaactttaggtagaaattgctgttagggcaatcacctacctcactatattccactctctcttctggatattggtgctcagcccttttttgaaccgcaaaccttattaataaaatagttttcattctttgagcgttcctcttctcactgcccacccccccgccaccaccaccctactgactttgatgagctgaactgaaccactcttttttttcttttttttcttttttttttttgagacagaatcccgccctgttgcccaggctggagtgcagtggcacaatatcggctcactgcaacctctacctcccagattcaagcgatttctggctaatttttgtagttttagtagagacggggtttcaccatgttggccaggctggtctcgaactcaagtgatctgcccacctcagcctcccaaagtgctagggttacaggcatgagccacccgtgccaggccctgaacactttttttttctttttctttttttttttttttttgagatggagtctcttgttcttgtcgcccaggctggagtgcagtggcgcgatcttggctcactacaagctccgcctcctggtttcatgccattctcctgcctcagcttcccaagtagctgggattacaggcgcccgcaaccacgcccagctgatttattgtattttttagtagagacggggtttcaccgtgttagccaggctggtctcgatctcctgaccttgtgatccgcctgcctcggcctcccaaagtgctgggattacaggcgtgagccaccgcgccggccctgaaccactcttcatcaacttatctgggaccctgaaatgaaatagggtgacccattttctagctttatatgattttctggcttcatatgatttaaatatttttaccgttttttgtttgttttgttttgttttgtttttgagacagggtctctgtcacccaggctgaaatacaatggcccaatgacagcttactctagcctcgacctcccaggctcaggtgattctaccaccccagcctccagagtggctggagccacagccacgcacctaacacctggttcatttttgtatttttttatagagacggggttttaccgtgttgcccaggctggtctcacactcctgggcttgaccagttcaccctccttggccttccaaagtgctgggattataggcatgaaccaccgtgcccagcttttgaaaaacctgtacaataaaaagtttggactaatgttctttgagcccttaaaaaaatgctattcaattaaaaaaaaaacaaacctatagtgtcttataactccaaatcccatactgtcacccaactggtctgccctggtgaccaccatttcctgacaaacattcaaatcactcctgaggaattgaagaaattcacatttatgacccagtgacactggccttgtctcagttcctatagtgtgtcatactctgttctgcacagaagttttgctcatcctattcctttgtttgcagaggtcccttccccatcccctatctctcaggcagactcctcatctcagtttatttacgacttcctcagggaaagccttccacacttccctgacggatgactttcccctgttgtgtgtgctcatagcaccatttacctacttcgtatacttgtgtggttattttatgtttatttgtgtgattctttgattggtgtctgtgctgtcccaagattaaaaacttcatgagagaagaaaccatgtctttttcttgtttttgtttgccattgtatccccactgagaacatggtgaataaatacgtgttaaatgaatgaatggccttttttttttttttagctggaaggacataaaattcttacatacatatagtttttaagaattatggctgcagatattttggatttcatctctggattaagtcagaatgtcagacaattgtgtacttgcacagtagtactttgttcctttacataattgttttttcttaattgaactttggtagtgtgccc

SEQ ID NO: 533 - DNA, 19701 bp, Homo sapiens
ggctgcagttctagttcttgtattatctagtgtgatatctgtgatacatacactcctccttatctgaggcaattaaagacaaggtgtcacagatcactaagcactataattgtgccactgcactccagcacatctggatgtactgaggtcataacaaggcttgatgaggcacatctcacgcgtgcacatgaaaatctaatcatcatgcttatgagctgcaaaagaattggaggcaacattttaaaagtactttttcaggctgggtgctgtggttcacacttgtaatcccagcactttggaaggcccaagcgggcggatcatctgaggtcatgagttagagaccagcctggccaacatggtgaaaccccgtctctacaaaatacaaaaattagccgggtgtggtggtgcacgcctgtaggcccagctactcgggaggctgagacaggagaatcacttgagctcaggaggtggaggttgcagcgagccgagatcatgccactgcactccgcctgggtaacagagtgagactctgttttaaaataaaataaaagtactttttcaaagacatggctactgttcagatgcttgtatttttagggtgtgtgtgtgtgtgttaaaaactttccagtgactaacacaagtattcatttgtaacctcagtgtgtactgtacggggaattattcctgccaatttaattctaactctaagcccctattccggtaggtagacagaaaacagttgtaactggggctccctccccctgcctagggccacatatacatttagggtttgtataagctaccaggaaggatggggtaagggtcccctaatcttccagctaggatgatcacctaggagaccgtttttgtcccaagtctgaccagtctccgaatgtctagtggtccaatattgggagccttggtataccagggcttattcttaccatctgggacaaaacacgggcaataaaaggaatttttcttaacactaaatgtaaaggaattcaaagtaaagtaattggctttttaaagtatatccttggccaggcgcggtggctcacgcctgtaatcccagcactttggaaggccgaggcggatgaatcactcaaggtcaggagatagagaccagcctgaccaacatggcagaaaccaccgtctctatgaaaaatacgaaaattagcgggcatgatggtgcgtgcctgtaatgctagctgctactcgagaggctaaggcatgagaattgcttgaacccagaaggcagaggttgcagtgagccgagatcgtgccactgcactccagcctgtgaagtgaaactctgtctcaaaaaaaaacccaacaaaaaccaacgaaacaaaaataatgatatccttcctactttcttgatgttaaaatgtcttttatgaaataaccgtaagatgtttaatatgtttaatttatttagcaaaataaagtgttggtacctttatgtccgttacaatttttgtgtggatagagggtggggaaggttgacaaagataaaaaaacctggacattaaagtggtgaaaaccaattttattcagtaattactaacagtaggggaaagagcagcgttccatttcaatgcagagataattgagcagcttaaagagagaataagggagggggaaagagccggaatacatgcaaaacatttcaaagtctgtcagtataaaagtgattagatcagctgcgtcagctagctggcgattatcactgaagtcaggattctaccctcccaccaagaatgggagatagcaaccttccagatgattaaatttcaaaggaatggctttcaggtccttaagaaagatactcctgaattgtaggagagaacacatacgtgtcaaggggacagaggaaggactcacaattgtaagctctttttttgtaaatgctccaagaaagggggtcaagggcctatggccaggtgggcagtgttgagttttctctgggagacatttaaccgagaggcccggggagagatctgcggtcatcctacgaacacgaccttatgctgctacaaggctcgctatagtttggtggtctccttttgctgaggtttggacaaggtcattacgtgacaagagttctgcagttctcatgatccatatgtcattattaggtaaaatctgttaggtttaaaattaattagtgtaatctctttgatacctacattgctccttaactgaggcaattaaagacaaggtgtcacagatctctaagcacttctagattctaaaaacccatagcctcaaaggagcactgcccctcaatgctcacccccacacacctcccctttctgttacctagagaaaaagaccaagacctgatgacaaattttaccatcaaacttaagtggcgcatgccaacggttcgaaaaggaggcttttcatccagagagaactgcactgtcctacgccatcacaaaccaaacaccttaacgaaggcttgaaagaaattctcagacctccagatacaggagacaggggaaaacagaagtgcaagaaagaacagcaactgtttaccacaagggcctctggataacttcaagaaagcagttacccaaattagctacagaaaggcctaaattaactaaaacagttacgataaaaccgaagtcctgagattttaatgtaactccaaatgttaacatagtttcttcatagtaccttcatagtaccttttgaaagctccctacaaatttattatggtaaagtgtggctataagtacaggtcctgtcactggctgcattcaactgaaaaaaaaaaaaaaatagtgcgaccacagctcctgtcactggctgtattcaactttaaaaaaaaaaaaaggggcgacttttttttttttttaagacggagtttcgcttttgttgcccaggctggagcgcaatgactcgacctcggctcaccgcaacctccgcctcccgggttcaagcgattctcttgcctcagcttcccgattagctgggattacaggcatgggctaccacgcctggcttatttttatttttagtagagactgggtttctccatgttggtcaggcgggtatcgaactcccgacctctggtgatctgcccgcctcagcctcccaaagtgctgggattacaggcgtgagccattacgcccggcctttattttcaatgtatatgttaatatcaaaaactttacatttccaatttaatccactcattgcaattgtttttgaatgcattccatttatgtattagtaaaatgtattattaaggaaagacaaattaagtcagatatttggattaatcattgagtctatcattttagtaaaaagcaaggaactttccttcaggactaatatattaaataggccaaaacactgacttgtcatttaaaaattttttaaggtcacttcataagtataaaaaactcatgcatggtcgggcgcggtggctcacggctgtaaccccagcactttgggagacccaggagggcggatcacctgaagtcaggagttcgagaccagcctggccaaaatggggaaaccccatctctactaaaaatacaaaaattagccaggcgtggtggcgcgtgcctgcagtcccagctactcgggaggctgaggcaggaaaattgcttgaacccaggaggcagaggttgcagtgagccgagagcgcgacactgcactccagcctgggcgacagaggagactccatctcagaaaaaaaaaaaaaaaaaaaaaaaaaaaaaaaaaaaaaaggcatgcctaatagtatttataaaatactcgcatacattttacatgttaatattattacgaaataaagtaacgtttatataattatttcaatagctattcctatttaagtaataattgggtaaatttaacagcaaatacaagaaaaaactgcatggcaagctattttccttaaaacatgattctgaacactaaacgttacaaaaacagatacttgctacaactgtgaaggagaaactgcatttccctattattacaagaacaaaggttttcacaaaaaaatttaaggactctacagccgccttgttctttgttatcccacccctgcccgcctcggctaacggttttggggcccgtttgcttggtgcgtctggaactcctcgggcggcgggcgtctcgcaggaaaaaccgcggcccgtactgcgccgggagcagaagcgctggtggccctcgtaggtcccgtgggctgcctccccctcctgcagacactcgaggagccatccggccgcgtctctcgccgcccggccccgccactaggctgccgcctccgccgctgcacagagaagggcgaagacccgcccctgcaggtgattgacgggcactctcctccaatggtcaacgcgctcggccccggcgggctgggcaagggccgcggctcgcggaggaatctctcttgccctttagtcccgggcaaggtgttgcggccggcgccattttctcgagccgcctgtttcgggtgccgccatgttggtgaggagaaatcaccgttacggccactgtccaaatccccgcgtcgctgcacgccgcccgcccgctcccacgccacagccaccggcggcgaatagagactagagcggcagcgccggcagcgcggggccgttgcccagtgtttgcagttagagccccatctctctggcgtggttgttaatagactggaaagtctgtgtctgtgtcgctcactagtaaccgtgagtttttaccacttcgtcacctgtcggcggcggccgggagcaggttcccgcaggcggcgcggggggtcttccccgcgccccgccgccgccggcctcgcagacctgccctccagccccgccccgttcttgaccaaacatgacagactctgaacatgcagggcacgacaggtcgggaacccttcttgtctgtctttctgtcggatgagaggaggggtctggggcggcgggagcgggccggggccgggcgcctcctgcatgacctagacgtctctgtgtggctccgtcagttccatgacgcgcactcttatgtaaactgctggatcgcggccgcgggggaggtcggcccggccgcgcccgcctccccgagccggggtcgctgctcgccagcgccggccccgcccccggccgggcacgtgcgagccccccgccccccgggcgggctccgtgtgcgccgggcggctctcagcgtcccggctcggtgctgaggtcctgcttctgcccgtccaggtgtcggtgctcccggccagataggaccagccaggaattttcaggaatgggtgttttgatatttgactgcttcccgagaaccgagaacacctctaaaaaaataaacatttggttttcagggaagttttaagcagcaccaaaaggccatctgttgtatacagtcttatcccttggaatttgagatggcaagtttcaagtttaatatgttaacacaaaatacttaggctttgcagaaacttagtttagcacagttttaccctaacgtaaaaactccatggattattccggctagcccaattttctagatggtgtgtatcacttgaatattgagattctgattttttattttttgctctgtgccttaagaggcacattcttgtttccattcgagtttggggacatttacaaagtatactgtagcatacttaaattttggttataattcaaattttcattcgtatatatctttaataatgcgaaaggggggctttcattcattaaacttactgaaacaaaatccattgcatctgattcttacttagaatattaatttgaaaatctagaacctcacaattactcctttgtgaatagaagtaagaaaaaatatacgttttactatagactatatacattgctgaagttttatctgtagtaatgtgatcggcttggtaaagcatcctaaacacgttttttaaaacccagaagcaaaaatcacaaacactgctgaaatttgaaatatctaaatacctagcaatcttgagagggataaaaatggtatttcaacaacttcagtattgtaataataaaagtagattcccagagggcacgtcaatcaaagtgtaaaaatttttggaaagtaaaatgcacttttaaaaatgataagcttgcacttggcacatttttaatgatttttttaacgttatcttttgtattaaaaaggaaattcttagaatgggttgactaataccttgctcttgaggtatggacaaaccaatgatggggttttgctaatggagcctaaaatcctttttttttttaatatggaagaatatctgttcccctctcttagtgcacaaagtaacttctatatatggagttatgtattgtacatcatgaaaaaacaatgccatcaaattcaagtatcaaaataattttgctggtaaggaactgtgatgacagaccttttaaagaatttgaaattttaaaatactggtttagaggttagaaaactttaaagaattatttgtaagatatgttaataggttggtagtaggagctaaagattaagattagtctattttatttaaaattcggactaaaagtattttctagtgatttctgaaacaaaaaggttagctccactttaacttagccaattgttaagtggcatcattgtgctgagatgaaggagatggtttttttttttcatgctttttttgtcaacccacatgaaaaacaaaacaactacatcaaaaacaaagtgaactagaagtcaggagaaattctacaagatcagatcaatggttctaaaccttccctggggaactttttttctttaaagtattggcgctatttctgttggtctggacctcagcctgggttttaagagttctaaaagctccccaggaaattctaatatgtgccaaattgagaaccgctatactcgatcagtgtttcccaatgatagttaatcatcagaatcactttggggaataaatttttgttctgcccagagcaactgaatcagaatctctagggtatttttcataggctccctgggaaattcttaagaaatttggggaaaaaatggactaatctgcgggcttccaaaatactgtatctttccatataatagctattttatgctgttataaaagtttctgtgaattaagtggagaaaaatatatgaaacttggtatatggagctaggctttgtctcaaggattttattttatttattttatttttttgagacggagtctcgctctgtcgcccaggctggagtgcagtggcactgtctcagctcactgcaagctccacttcccgccttcacaccattctcctgcctcagcctcctgagtagctgggattacaggcacccgccaccacacctggctaattttttgtatttttagtagagaccacgtttcatcatgttggacaggctggtcttgaactcctgacctcaagtgatccaccagccttggcctcccaaagttttgggattacaggggtgagccactgtgcccagccaaggatattctttttataacattttcaaaaattaaggcatattgtgtatgcaggaaaaaaaatgaagcctatgatttatatttacaattgctttgattttatacaaattaaaatattactgtttatgagaatgagattctaaatgtaaatggaattcacagaatgcataatttttttctcgtttaaagaaatagagtctcgctatatgcctaggctggtcttgaactcctgggctccagccatcctcccatttcagcctcccagagtgttgggattacaggcgtgagccaccacgcctggccttgtacatgttatatagtgaacattttgcacaagattgtttgccaaatgaataatttaaaaaaaatccatttagtgtactttcctttaaatattttcacacctggagttaaaacattgtattttataagatgttattaatataaaaatacttctaattctacttgtggctatgtagaatgtagtagaggacttttgcataagcccagagcctagtttctaaaggtctttagggatttagggaaatcagagggaggtataattctggtctctcgtcgttcagttctttttcattcagttctctcaggcacgactccagccgctcagttttatatttcaactggatgttgacccaattaaaacaattcacaactcctgaagacgaaatactatgagtccctgctttggacacatctgtagtagagtaggaaaagataaatataacccaagtaattgttacagaattttctgaaatatactaatggtaaaaggttttgtagggcttgtactggggaaaaagataattttttagcatgaaccttttaagagcttgtgagtctcaaagagtctttaactgataggtgatatggataatactcccctttgggaggaggtttataatacataaacaacctccccacccttccctcgcagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagcattacaaggttcagtgaattgtctgagatctcataaatacaacctagataagaacccaggtattattattttcagtcttgcaatattattttcctacttgcaatattatcttcactcttcattaagtttgcacagcaaagtaatggaataagttctgggctttaatccttgagtagtttggaattgtaatgtgctacatttgagagagagcccttcattttgaataaaaccttggtactgatcctgatcttctaacttgggttaatgctcttccccttttcattatttttttcatttgtgaaatgaagtagttgcactagatcattttcaattttccttcccacttaaatcaattttaattaaaaaaattgcagatgccttttctcagattagagtacactttttgctccacacaatatctggtttgtaaattagtatgttccgtggagtaaataactttcctgactagccattaacttacttctgattcctgaatccactaatttaactattgttgaaattactaaaggaaatttttctttagcaaatgtaaaacctcgtatcaggtctcaggtttgatgttgtaaagcactctgactctcaggaagactctttttttcccccaacctctcataaacaaatatttcattcattataaaatttcattcattacattttcattcctcagacttaacagtgtttcgtctctgctaagtatagtgttaagcactgacaaaagaactctggacacaacatcatgaacttgctctctgggatcttataatctagttgcagaaacagattggtaaatacatagtatagcacaagtactataatggaggcctgaactgagtgctgtgggggtacacagatgaaggcttctgggagacatcatggcataactagacctggaggatgaataaaactttggccaagtaaatacagagatacacgaaaagcatggataaatggcacaagtaggttcagggatgataaaagtgttagtatgtggagagtgtacaactattttggggaatggggaaacggattaaatttggggccagaccctgaaggatgtggggatcccatcaaagtcttttaagcaggagaatgatcagatgcattttttggtatactacctgggggataggaggaaatggactacagaaggggagatcagtagaaggaagacaagttaggaagcttttcagtcattttcattaaacatgaagcttaatatgtattgttctaggatcaggaatacagcaataaagaaaaaacttggtgtaatgaaacatattttcttgggagagacagaaaataaacatgaaaaacagatgtgttcaatggtgataaagcagaaagggagatggggagtcaagtggatgtggggagggtgtttagggaagcacttatgaaagagtaacatttgagcaaagagccctgatacaagacaacaattcagacccaagacatttgaggaaagagcatccatataaagggagtgggaggtagagaaagcctggaccaggaatgagcctggtatgattgaggaaaacacaagggatttcactcttgagtgacctgggagctaatgggggattaaacagaggagggacaggatcctctatggtatatggtaagtgagtagtatggtaaatgaggtaaatgaatagtaaaaggaactgctgtggtaatttaggtaacagatgatgatggtttaggtgaaaatggttggattgtggatatggtttgattggttttagaaccaataggatttactggtggctggatgtggacaatgagagaatagaatgaaccaaagctattgtaaacgtctagaaatcagatgaggacttgaccaaaggcattggcaatgagaaagtaggcacaattcatgaggtatttcttagcattgatagagttggatataaatatctggaatttttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacactccacagtcttatcattcatagtttcttggcaaactcaccactcaaggtgtgcctcacttatttaggagatctgcctcactagggtagacattttaggtttatgactcttaagttttcacctggacagattggctaccaaaaagaacctcacaggtgggtgaccttgaattcaccaggtcatgccatcagttcagagcggccggagaactctgttctcttgtgcattgatgcccccggagttgtgaaacacagtggccctgctttagtttttttagatttagaaactgatcagtgtcagagcgatcagacacaggaatgttaattcatgttcaaaaataataaccaggctagcatttgtttagcacttgctatgtgacaggtactgttttaagtgctttacatgaattgtttaatcctcacaacaaccctgggaaataggtcctattattaggcaccctttctacagatgaggaaacagacaacagattggtaagtttcccaagatcacaaagtaagtcagtgggaactcaaagtaacctgactccagagcccactctcttatctaagcatatacattcccatcacaagagaacgccagtttattcaagtaaaataaggactagaaatttacatcaagaaatatattctttcaatgtagaatgctgaatggaaaaccaaatttcaatagttgcctactgaacaagatcatgagataacaacaagggagttgattataaatgactagaagttttaaatggcatcggcgctgataaagtgataatctcagctccatgatatacttgtcaagcagttacttacatcaatctgccttctaggatatcctttctcctggttgatgcttatatgatagtgttttgtacctttcctttttcactgcttccattgctgaccaaactactcacctccatatttctggtagatatattttttctcattgcatgttagtatcttaaatttagtcctatcttttgcttgatcctctgggcttgacttcctaatctatgttctggtttatgttttagtttgacagttgagctttctgaggacattcttattcccagtatctttttttgggtggttgggttctgggaggtggtatttgactgctgctgatgtgtaccaaccaagacagtagtcattaagtgactaacaataatgatttcagcagattattattactcttggcaaaaagcaagctttctctattataaatgattttatatttgttttgtttttctttatttgtaatttgagttctagcttaacattaatacttcagataactgttaatacactttcataaatcatacccacattcttgaatggcaaataaataaataatcaagttccgagtagtttctaaagagagtaaacattaaaagtaaacataaaactacataaaaatcaatcacagtctatttataaagttggtatgaaaacaaagatcctagatttggaacactcatgatactcaatattttacatatatcagagtttgtaatttccataacttcatttggtagttagacatatagacagagaagatattaatatattcattttatagtttaggaaacagacttggaagggcaaataacttgtctaagatgactaagcagctgagtgagaaccacagcctatctgtggcattcagtctcagccatctttcccttgcttcataaggatcgttactctggtatcagttgctggactgggattttgggcatttataaatgtttttattttggatatcactgaatcacagacaatttcatcttagttaaaaattcatctgacgtgacacttgtctaaatcttaaaatattaaattttaatgtataaggatgttaataatctttatattttaagagactatgaagtcaagtctggctaacttagatctggaagtttttagctgtggaaagcaattctattgtgtacaggtttcagcctgtgaagggaattcattgaaaatgcatagagatcagaagaactaacacctttcttgcatggatttttcttgattattggcagttaacaataaaatgttattagatcactggtgcttctgtgtggggttgagttttttatgatatctcctgttagacccataagggaggctgtgagttgttttctacatccttggactatataagatcctcttttaaaattatattttatataagcacatgaaaatggaatgaaataatgagttgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatgtgtgtgtatacaaatatgtatacacatacataatatctggagcaaaaatgattatgttgtacagaacttttggaggttttcctccttataaaattctgaagtggtagagttaacattctgcttttaatttatctccaaaaaaatgtgaagaattcccaaataagattttctcatagaagattcatggattttgagtctgagaaaaaaaaggaagaaaaaaaattcatggtataaaataactaaaaattaaatatagtctttagaaatgattttgtttagtataattaatactggtatgacaactgaatgcaattgaaattatgatataaaatttctattctgctttgtatttttcgttaaagtttttataattgtcatctgaaaaaggatttaatattcttcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctcaaattggaaaatgaatattcagatactgagtaaatttttttttttttttgagatggcatctaactctgtcacccaggctggagtgcagtggtgggatcttggctcactgtaacctctgcctcccgggttcaaattattcccctcccttagcctcctgagtagctgggactacaggcccacaacgccacgcccggctaatttttgtattttttggtagagacggggtttcaccatgttggccaggctggtctccaactcccaacctcaagggatctgctggcctcagtcttccaaagtgctggaattacaggtgtgagccactgcacctaaatgacatacttgaaaaaatattctcgggccgtgtgtggtggctcacgcctgtaatctcagcactgtggaaggttgagggtggatcacctgaggtcaggagttcaagaccagcctggctaacatggtgaaaccccatctctactaaaaatacaaaaattagctgggtgtggtggcatgcgcctgtaatcccagctacttgggaggctgaggcaggagaactgcttgaatccaggaggcggaggctgcagtgagcagagattgccccactgcactccagcctgggcgacagagcgagtctccgtctcaaaaaaaaaaaaattctcactttctgttgttgttgtttgtttaatgattaatagatgatttatttaagcaagaatacatagtcatcattgccagacttaatatgacaggttaaatgttggacccaattttccttcccagataagtttttctttcctatccatgtcagttttaaaaacataataccagaagaagaggggcccaattccacacagagctcccaagagtgagtttttaggagtgggtctgaaattaggaaagacacttgctgatcttgcataggtccagggaatcaaggcaggattttcgatgagccctcggcagttagggtaagcaggtttcagccaggctcttaatggtcaaccacttggcttgcgcccgctgggtttccaaaaatatgtcctgttcggctgggttgagggcatagtggccaggggcgaaggagtatactttgggaacgacatcttggcgacccagcgcataactcacttttttttggaaacaaggttggctctgtcttccagactggagtgcagtggcgcaatctcggcgcactgcaacctccgcctcccgagttcgggcgattgtcctgcctcagcctcccaagtagctgggactatgggcgcacaacaccacgcccagctaaattttgcatttttggtagagacggggttttgccatgttgcccaggctagtcttgagcctcctgggctcaagtgatctgcccgctttggccttccaaagtgctgggctcataggcatgacactgtgcctggacagatttttgttatactgtttagatatgatggtaactgaatgatcatgcaatctctgaccatgtgacattcagggataccaaaaatgacttgagatgggccaagggagaattggagaagcatactttggctgaatacttaggccaaagtataatttggaacatttcttttaaaaaatctactcccctatgccccccacttgcagtaccttacaattacagttaatctagtagcagatactggattgggatattaggtatttacagaccaaatgcccattgggatattactaggtaacaggcagtttcactctggttcattgtagattcatccagtaagcatttctagagaactgctatatgaaaatattgtggaaagtatcaactttttaaacttttgatgtcatggcacctagaagattattttctgatactcatattctaagggaattttgttttctgagatttgtttctgtggaatttctagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggcaagctaattcagtttgacttattcatgcaatagtctgtctctgcttatgacataaagtataatatattttaggaatagtgtggttttcttcatgatgtcaaacatacaagcttatggatatatttaaaaattcttaattttctagattaatgttcagcactacttccatcttgcattggatgggggcagataattaataattatcagatattttcttatcaaaaacaaatttgttggaaaaaaaattttttttttgagatggagtcttgttctgtcgcccaggctggaggtgcagtggcacgatctcagctcactgcaagctccacctcccgggttcacgctattgtcctgcctcagcctcccacatagctgggactacaggcgcatgccaccacgcccggctaatttttttgtatttttagtagagacagggtttcactgtgttagccaggatgctctagatctcctgacctcgtgatccgcctgccttggcctcccaaagtactgggattacaggcgtgagccaccgcccccggccgttggaaacattttgaaggaactctttgtaaataaaatacatggcatgcctttctgttttactatacagttgctgatttatcctttagttggttactttgaatcatcattaacatctgttgtcaccataatccctgtgatcactagatgtcatactccattttatgttttattgttgccttggggagactttgagagtatgagaggtgttcatgcagactgctgctgagtgttgcatagagatggaataaagtacaaataccttcaggaacagactccaaacttggtctattccagcttcctttcattttttttttttaaacctattccagataatttttcattggtattctctgaaggaaaataagagaaatttcctcttagaatcccttctccttggatttgtaacctttcccagttcatttctgtggaagtacttgtagtccagcatagtaattctattcagatatgtatagttcagttaagtcacgaagggaaaggaagctttcgttgagggctatctactaggtggtacagtgctaggtaattaactttatctcaatccttaaacaactctgcagtggtaagggtgattaattcatcccattttgtagacaaggaaactgaatgttagagggatggcataatttgttcatgttcatataggtagtactttgggaagcagaatttgaacacagatctttctggttctagagctttgtgttcttctaccttgctatgatgttaagtaattagttttaacatgccacttaagtttaaagccttaagtagtccttttaagaaatcttttgttgctggttattctcatttaacactcctattttaatttccaggttcaggtgacctcactttgccagaaccgtgggtcttcatgaaataagagatttcatttggtttttgttttggtttgcatcctctctaactttaggtagaaattgctgttagggcaatcacctacctcactatattccactctctcttctggatattggtgctcagcccttttttgaaccgcaaaccttattaataaaatagttttcattctttgagcgttcctcttctcactgcccacccccccgccaccaccaccctactgactttgatgagctgaactgaaccactcttttttttcttttttttcttttttttttttgagacagaatcccgccctgttgcccaggctggagtgcagtggcacaatatcggctcactgcaacctctacctcccagattcaagcgatttctggctaatttttgtagttttagtagagacggggtttcaccatgttggccaggctggtctcgaactcaagtgatctgcccacctcagcctcccaaagtgctagggttacaggcatgagccacccgtgccaggccctgaacactttttttttctttttctttttttttttttttttgagatggagtctcttgttcttgtcgcccaggctggagtgcagtggcgcgatcttggctcactacaagctccgcctcctggtttcatgccattctcctgcctcagcttcccaagtagctgggattacaggcgcccgcaaccacgcccagctgatttattgtattttttagtagagacggggtttcaccgtgttagccaggctggtctcgatctcctgaccttgtgatccgcctgcctcggcctcccaaagtgctgggattacaggcgtgagccaccgcgccggccctgaaccactcttcatcaacttatctgggaccctgaaatgaaatagggtgacccattttctagctttatatgattttctggcttcatatgatttaaatatttttaccgttttttgtttgttttgttttgttttgtttttgagacagggtctctgtcacccaggctgaaatacaatggcccaatgacagcttactctagcctcgacctcccaggctcaggtgattctaccaccccagcctccagagtggctggagccacagccacgcacctaacacctggttcatttttgtatttttttatagagacggggttttaccgtgttgcccaggctggtctcacactcctgggcttgaccagttcaccctccttggccttccaaagtgctgggattataggcatgaaccaccgtgcccagcttttgaaaaacctgtacaataaaaagtttggactaatgttctttgagcccttaaaaaaatgctattcaattaaaaaaaaaacaaacctatagtgtcttataactccaaatcccatactgtcacccaactggtctgccctggtgaccaccatttcctgacaaacattcaaatcactcctgaggaattgaagaaattcacatttatgacccagtgacactggccttgtctcagttcctatagtgtgtcatactctgttctgcacagaagttttgctcatcctattcctttgtttgcagaggtcccttccccatcccctatctctcaggcagactcctcatctcagtttatttacgacttcctcagggaaagccttccacacttccctgacggatgactttcccctgttgtgtgtgctcatagcaccatttacctacttcgtatacttgtgtggttattttatgtttatttgtgtgattctttgattggtgtctgtgctgtcccaagattaaaaacttcatgagagaagaaaccatgtctttttcttgtttttgtttgccattgtatccccactgagaacatggtgaataaatacgtgttaaatgaatgaatggccttttttttttttttagctggaaggacataaaattcttacatacatatagtttttaagaattatggctgcagatattttggatttcatctctggattaagtcagaatgtcagacaattgtgtacttgcacagtagtactttgttcctttacataattgttttttcttaattgaactttggtagtgtgccc

SEQ ID NO: 534 - DNA, 15369 bp, Homo sapiens
gtgacttcttcctactttataaacaatgtgttgggggtgaccaatataaaaagaaaaagaaaatgaaatatggcttacatggttggtaattatttttatattgttatgagatagccaactcaaggttcaggatgcataaatgctgtcttgtgagttgcctaaggccttggtggtttgtctatatagcaatgtttttgaaacatggaacacctacaaagaggtagggttttcctggtatgcagcgtctcaattctgtggaatccagggacttgcatctctctgacagctttattactcaagtgtgaatggatatcctcagatgatctttttttttttttttttgagacagagtctcactctgtcgcccagcctggagtgcagtggcgcaatctcagctcactgcaagctctgcttcccgggttcatgacattttcctgcctcagcctcccgcgtagctgggactacaggcgcctgccaccacgcccggctcattttttgtatttttagtagagacggggtttcaccatgttagccaggatggtctcgatctcctgacctcatgatccgcctgcctcagcctctcaaagtgctgggattacaagcgtgagccaccgcgcccggcagatgatcatttttatcaaacaatagtgaaaacatcaaacaatagtaagaacatttgtttcaataaataatgatccccaaatatcaagattatcttaatcatccttttaatctctctgaagcagttgacagtgctgatagccctccttcttgaaactcctcccctgactgccatgactatgggtcacagtcaaaaaagtttcaaacctactgctttaaggtagaccaataagtagaaagtgacatcctaaaaaaaaaacgaagaataccagctaaggagaaattttaggcattataaatcaagtctatcccgatattcccaattctatctctgatgagttaatagaaatctaatttgatagttttagcttttatatcctatgactaatgtccaatcaactgtctgtattgtgtaactattggtctaaccgtaattcttttttaactgcatcaacctgtggcattgttataaattaaacttttttcttggtttggatttttgatcagtgaatggagtcaaactgtaacatagacataagtattagtaaaaatacggcacttactttgacctttggaagacagctgttctcagaatgattgggttattctcactgatacaattttgggttctaagttttagcccaggttcagtgtctctgacatctacacaattcaatgcagatttatttagttttttatgaagacattggttggattttttaaaagaaattcttttgaagcagaaaattgactccatgcagatttttcactctgttgcacatattaaactacaacaatttgggtgatggaaaaaagcagaaataatttgagaggcgtgggcgaaaaggccaataaggctataaaaatttcgaattacaaagagtcaagagaatattaccaaccttttattgtcagagaaatgaagagtcttacttgtgcccttgaacatgaaaggtggggttgtcagtgaatttcaagagcaattctttaaatagaggtgggtggttctcaatgagacatgagggtggtgtgaaagtggctacgaccttaaaccagtgagaactagatacacacacacacacacacacacacacacacacacacacacacacagcagaaggtagagttaaaccaatctcagttaaaatcccagctccttcacttaatagctgtgtgatcttgggcaaatcacttaacctccagtaagctagttatcttgacttgttagtatcttgggaagataataatagccttcctgagattggtcctagatgtaaataagacaatttttgtcaagtgctcatcaaagggcatggcagaaagtactagctcaatatttactgtattagtttcctagggctgctataacaaagtaccacaaattaggtggcttagaacgactgaaatgtattgtctcacagttctggaggctagaagtctaaaatcaaggtgtcagaagggtcctgctccctttgagactgtaaaggaaagatctttccttgctgtcttcaggttctggtatccccaggcattttttggtttatggcagcataactccagtcttcacatggcattctccctgtatctcttcacagagtcttcccttctgtggatattggtctctctctgtccaaattgactctttttaaaggacaccagtcatattggattagggtctaccctaatgaactcattttgacttgattacctctgtaaagaccctctttccaaataaaatcacattctgaggaactggggttagtacttcaacttatcttttgcaggggtgtgggaagaacacaactcaccctataacaattatttatgaaattatcttgctagaaatattctgcaggagatacattagtacatgaagtacttcaaaattgtagaatatcattctctagtgattcattttctgtttcttttctttttaaaggaaggagtactcagtcttttcaatggaatgacataggtatgaacttaatgagtatccttcctgcgcttagctgaatccggaaaggcaggatattgactcctttgccattctatagattcctggtcttgaggcaaagaaaactggcacaggcctttgcgactgggcctgcaaaagtatatactacacagagaaagggcatgtatccttactttgaatggtgtgctaatcgtctaacaacttcaattgtactaatcacgaatggaagagaacggctctttaatggaacttcaatgaatataaattacatacttactaatcaaaatgaatccttttcagctaatttctttttttctccttaaatgtcttgagtgagtaatataagcttttgttattttttttggccagttttctctgccataaccctgattgtaactccactctcatcatggaacttaatgcccaaacactacacattaatttctatttcttcatatgttttacaaaatgatatatatttttgccccaaactgcaacatgctatgaaggcttaatattctaacattgcaatcatgggtacaacctaaaaaaagacttcaaattagttagcaaaggaaataaaaataggactctctggggacagaatgcaggccagtaggggatacgacaccttggtgggggtttttagggctatgttgattcattcaaatgccttaatgacctcctatgacagaaccatgtggcagagaaaaaagattcatatgccaatgtgaagggagaagaagaatcaaaatgaggaggaacagattaaatatttcacaatttaacaagatgatatttaaggcacctaatttcttgccttctaaaaactgctagcaaaatgtaatttcttgatagccaaaaaaaagaattcaaatgtacaccagcctcttgttacactataaaaataaggccaggcatggtagctcacacctgtaattccagtactttgggaggccaaggtgggcagatggatcacttgaggccaggagttcgagaccagccttgtcaacatagtaaaaccccatctctactaaaaatacaaaaattagccagacggggtggcacacaccggtaatcccagttacttgggtggctgaggcacaagaatcacttgaacctgggggaatttgcagtgacctgagatcgcgccattacactccagcatgggtgacagagtgagaccctgtctcaagaaaaaaatcatgaaaaatttaactataaatccagacttcataaagcaaacatattttccctttgacagtattaagtaatttagagatttatttctaaatttagaaatttatttctaatttgtcctcaataatagtcatttctcactttgtaatttgtctttaccttggttttctaaaatagtgattaaaaacaaataattacacgtgctagggatgcacttcttaaagaaacttaattttagattcagccccattgaggacctgctgtgtttgttaagtgggcagcagtgatggatgaaggccacacggtggcactataagcaatgggctactgatgcaccttttaatcaacatctactctaaaaagtgagccagtccaagtagctttgagaaaactggaaaagtctgaggctgcaatgcagaataaagatgaataaagattacataaatgaaaataaagcagctataatcaaaaccacactctaggccatctaccaaacctaagaagccacttactgtgataaattaattacttaaaaaacaaacaaacaaacaaacataaatgcatgagagttttgctatttggtggactaaaggaaacttttttgtatgttctgggtttcttaatattttttattttgaaatacatggcactgatgaatttatcattgaactgcaagatagccagaaaactaagaattattagttcactagatatagccataacataaacaagtttagtcagcaagtctgtgtaatctgattgtttcagtcaactaagcaaggcaactgactttgacagcttagaaaagtgaccttctagatgaagagttctgaaggtgattggaagctcttatcagaagtgcatgacaaaaccgactcccaaagtagcaccaattaataaaacaaattagcaatataccttctctttaatgcactggtgctcgtatttccttctatgaaattttttctacttagcagctatcaatcaataccaaaacgattatctcttgctgtgcaattgttggacagcttgggaagcgaagtggtttatataaaaatttgaaacgtagacatgaatggaaaagaccactataatttgaaagtggcttactgctaccctgattttagactggtgcctaaggaaagagctaaaagtgatgcatagcaaactgcatgaaattgcttgctcttgtaaacagattgtagcaacagggtaagggaaaacttagactatatattaaaaatatagaatgaatacctttctcatgataccataccatattgctgaagataggggtgaatggcatacatatacttttaactgagtgaaaacaactccagaaagaaagaaaacataggttatatctgtgcctccttggagcattttcaaattataggattgtattctttatgtttttattcttgataaatttgcacctaattgtatgtttcagttcccaattaaatcaagagctccttgggatatataatgtatctgctaatttttaactcctccatggttataaaaatcatattaataaaataaaagctacacatgttaagttctcattagatgccagatattgtgataagtacagtagatagcattatatacataaacttcaccaaaaaacccccatgagattaggactaatgctctctctattaataaagagaaaacagaggtataagttaatttgccaagtactactacacactactaagtagcagagctaagttttgaattcaagaataccttctaccaaagctcccagctcgccttgtagagcagagattgaagcatggtggttaacagccacagtgcctgaggtctacccagctccaaagctgactggctttatggtctttggcaagttgcctagacattctgtgtctctatgtagttgttattataccacccagcagttcataaagtagaaattcaaaaactcttactgagaaccttccaacttctctcagctatctccaaccagttgctctaatgaacaaataaatcaattggcatttgatataattgaaatcaggtgcatatttgatttttccagtaatggtcttcaattgcttctgacagtcactgtgctgtgactattatcacttcaggtgattatagttaatatagtgcttttttttcttcaacaactctactaaaatgtctacatgtcaaatagagttggtaactgaaattaataatgtagatacatagtaaagctttcttgaaaagtgatcatttagagttctgaattttaatattactatacctcattgaaggattgacacaatttacctccagctatttcatttaatctgtgcgttgctgtgatttgaactaaaattacacaaggcaaggaacacaggcataacagaggttcctctcatcttcaggggactcattgaaacaaaaaaaaatcagtaagggataatattctcttctcacttgcaatggcattttgggcattcagcctctatatttagagaaattcattaattctttaatcagtggcatggaggcaatgcaagaattctgaactcaacgttaagaaacactattttcatccaaactttgcactgtgtatctcactgaacaagtcttttctatctgcctcagtctcttaatctgtaaaataagaggatttctattgttgaactttaaagttttaagaattgatacagtacaaagacaaaaagtgggattgcaagagttttataaattgctatgtgaagagcagaacaatgcgcaagtgcttgcatttgcttctttaaagcttacacattatgttgcagaagggtggaattgccctaaaaaacataagccaaagtgatctttaaccaaaacccttttatctagaacaagttctctcaaataggaagctatcaaactatttcaagcagcaaggaaacaaggcaaaaaggatccttttgctcactttctgagtccttttttgtccaaaagtagagtaagattaaccccaccctgttgtatgcaactacaaacactgcaaagaatagtgatagcactaaattaccatgaccctgtaggatcgggggaacacacaggtaaaacacacctgttatcatcttccacctggagaccttcaggaaagtggggattccagatcctaacaccaggctaatccatccttgaatcccttccccattctcagctttgtcttctctcctggcacagagtcagccttcaggagccatgaaactagagaagccgaggacaaacagaagcatctctagcagcagggtcaaagccttttcacagtctctgtgtgcctgctctacccactatgaacatgtttcatgaatgttctatgttcttcctcttagacacaatatccatagtgattaaggagctggttccagtccatattccaccacttactactcatgcgttttaccctctggtccttgattttgtcttcttaagaatggggataatggggccaggcacagtggctcacgcctgcaatcccagcactttgggaggccgaggtgggaggatcacgaggtcaagagtttgagaccagcctgcccaacatgctgaaaccctgtctctactaaaaatacgaaaaattagctgggcgtggtggcgggcacctgtaatcccagctactcaggaggctgaggcaggagaatcgcttgaacacgggaggcagaggttgtagtgagctgagatcgtgtcactgcactccagcctaggcaacagagtgagactccatctcaaaaaaaaaaaaaaagaatggggataataatggtatatatctcactagatgatgaagattaaatgatatagtgcatgtagagtgcttagaatggtgttcagccatacataaaagctaccataaaatgttaactttgaagactaaatataatacttagtgtccagtatttctcagcaaactttctgcaactacatccttcaatgtgttttcacaaacagaaatagattaaccaattgatatctacttaaatagtaaaactgcaacaattccatgaagaccatgtcccccaaatatgtcccccaccagcctgcagtgctatagccaataccattctcttgctgctttacgagggcagcttttcttactgtgagaatcgagaggcagaggactctctaacccttaaggggatgaagagggaaaagggtaaagaaccaaaggcctcaattacctactccaagaatgtcaattacatattccaagtttcctaatcttctctaatatttgctaaatcaagtatttttccaaccattcaattaccatagaacaactattaattgataccttacacagtcactgttctgagggacgttcttattgaaatgtttaactttgaaccacatttttcttatctcaaagtggggataatgatacataccaaattgggtagttacatataataaagaagatgatgtaaatgaaagtctctaccacagtgagccactccacactttcatatccctgcaggagtatcttttctcatcagaaataaatgttttattaaattgcaggatgagtagaaaacaggctgctgtctctagaattattttgttcagaaacaaatattctatgcatgactattgcattaaaaattggggtcaactctcttcttatagaattttaaagaataaagacatttctcagttgtgttttaatttttatcatttattatgtttttattttttgcttaatactttgtgttatcataaaagaagaaccaggcgatattcttttattagcttttcaatggctccagaacattccttcaaagaagtctttgtaaagtctttcttccccactgtcacagtccatgcattaaaagctgaccagctatgtaaaattaaagtcagaaagaggagagactataaacacaatttctagtgaattaagtgtgagaagtcactgagtaccaccattgccacacacaaaatcttgtgcagaagtgtcttctcatgtcttctaagttttgtgagaatcttcactctaaagctctgatgaaagcaacccaggcctggatcaataaacacatttactctgagccttctataattatcctgagaccaggagttcaataatgtcacccatgctcaggcttggtattcacagtcacctcttgatgcttccatggttcaacccaactctgtggccaacacaaataagaaactcttcgatctaccttgtgtgacttctcagagaaagagtttgttcctgctatgctgtaaaggagtacatgctatcatcacccaccttgaaacttcagtggtttccctagctttaatattctaagacactgtaaacaaaattcatgcattctattactgctttccaaattgtgtagaggtaaagcaaattcctctctaccttcattatttcaagactaaaaaagcaggcttcataagcgtgcaacctgtgcagtcacaagggaccccatgcttagaagagtcctgtgcttgatttaaagtcctcctgtcccaggcttaaaattcttaatttttgaacaagggtcccagccttttcattttacactgggctctataaattacgtagccagtcctgccagagtgtctgaattgtctaactctattctcatgtggcagtcatcttctcttcactgtctgtggcactgggaataagacatgaattaatgttggaagtcaaaaggatgagccaagctgagggccacttagagcagctgtggaaagcctggtcatatgacaggtatacaggcagcaagaaatgtccattgaaactgagtcctctgaaacctttgtgaggtcttctgtagtcccgttatttttactttgctcaaaactcatcagggtttctagatgcatcaagatatgtgtgttatctgtacataaaaaatgtatcacttctgtctgcaaaatttcagtattatatctcagagaggatggcaaaataggcttgcctgctaactgcgttcaaagatccacatacacatgctcaaatttttggtgagatgagtctgattcagttgtattactcagcattctgttaagtggccttcaatactgtcatacagtctaaagcaattgatagttttagtgcctctattacatcagaaaatacacaagaatgacaatatgagcaatctactctttttcaagaaagataagcaattcactagagatgtggaatgctgtttcctaaagcaatatcaatcctggatgtggttatgatgaaaagctagtagtcatagcacagtatgaacaaagtccagaaagaatactctgcccagagtcaaatctttctatcatactcagaggcgagctacaaataagaaaggaaataaacgctcatttcctctgtaaaacagaggatactttttctgtaaattcctttatgcacagactagggactgatgccattgacacagtggggaaatgactccactcactgacccactggggatgcaatcctaacagttatacttatgtgttagcaaggatcttcactgcagttaatgaatgtcccaattttgagagagaatagcttttctggttggcaggaatcaagaagtgcatgctcagttagtcactgctcctcatctgaaattccttcaacctgaggttaggagcatttatctaaataccaggagtccactggaatcctccagcctcacctcatgccagaaagagtggatcaatgacacattctggtcaagacaaaaagtagctggaaattaccatcacatcatagcactgaaaaaaaataaaaacgaaaaaccaaaaaactccttgagaattcccagcttatcacattatctggccatgaaagtttattcatattccaatattttccatcagatgcctcaaatcctttaagaaacaagatggaaatgaagggagagaagggggaaagagaatgagagagaattgactatgtgacatttgaatccaacctaaaactcacaccactcactacagtttcagcttctttaaataataataatatgcagaaccaacatactttttcctttgataagcctcatcccagcaccaacggggataggtaaggatagaggtggaataaggattaacctagtacaagctacatgattagtaaccatgtactcttttcagaaagaaacataaattgtttcaatcagataactgcctagtcaatgaaaattcacttgtatatggaattttctgcatatcggactttgtggttcctgctttaatgttacaattttaacactcacttatttttgccttttaataatgtggttgatcaataacagagcttaacgattttcattttcaaaatttatagcagtaatttttcagagttacaagtatctgggggggatagtttcaaaaagtatttaaggccaggcagtggctcacacctgtaatcccagcactttgggaggctgaggcagggggatcacaaggtcaggaattcaagaccagcctgaacaacatggtgaaaccccatctctactaaaaatacaaaaattagctgggtatggtagggtgggcctgtaatcccagctactcaggaggctgaggcaggagaattgcttgaacacaggaagtagaggttgcagtgagctgagatcgcaccattgcactccagcctgggtgacagagcgagactctgtctcaaaaaaaaaaaaaaggaaaaaaaaggcggagggtagcgtggtggctcatgcctgtaatcctagcactttgggaggtggaggtggacagatcacaaggtcaacaaaaattagctgggcacggtggtgcgctcctgcagtcccagctacttgggaggctaaggcagaagaattgcttgaacccaggaggtagaggttgtggtgaactgagatcatgccactgcactccagcctgggcaacagagtgagactccatcttaaataaataaataaataaaataaagaacaagtatttaaaatatatcttggctgggcacagtggctcacgcctgtaatcctagcactttgggaggccagcatgggtagattacttgaggtcaggagttcgagattagcctggccaacatggtaaaaccaccatctctactaaaaatacaaaaattagctgggtgtggtggtactcacctgtaatcccacctactcaggattgggaggctgaggcaggagaatcgcttgaacctgggaggcggaggttgcagtgagccaagattgtgccactgtactccagcctgggcgacagagtaagactctgtctcaaaaagtaaaatataatatattgggccgggcatggtggctcacgcctgtaatcccagcactttgggaggccaaggcgggcagatcatgaggtcaggagtttgagaccagcctggccaacatggtgaaaccccatctctactaaaaatacaaaaaattagccaggcgtggtggcaggcacttgtaatcccacctactcgggaggctgaggtaggagtatcacttgaacccaggaggcggaggttgcagtgtgccgagaccacaccactgcactccagcctgggcaacagagtgagactccatttcaaaaaatgataataataataataatataccttatatttggaaatgaaaatatatatactcttttcatatgcaaattatagaaagtcacatcaaacaactttttcatggctggtcaggatagaattcttctagatttttatgatggcatgagtttttaagtgctgcaaaacatctatataaagagcattatcttcttccaataagttttttgagatttctttttaattgggtacatacttaagggaagagatttgggccataatacaatctcctattctcagctccagtccgacaagagaccctaattaaatttctaactgttctctaaataacacatttacccttatagtaaaactcatttataataatgctttggggggagtacctgataacctcttagaggcttcctaattataaaagactaaataatatattactgcttttttttctaattctaaaataatacatctcacataatcttaataaagacagtagagataaaaatagcaccaaaaaatctacagatcaatttcattatccatattaagtgctaactgaacccagcattatatcaaaataatacactaccaccaaacaggattcatctcagaaataaaagtaatacaagaccaaagtttaacaaagttttcaaacagtatataaattaatacagtggaaaataaaaattgcccagaaatcagatggtggttaagtgtggaaaaagattccagggcatccacttgctttaactgtcaaaacgcctgcatcaaaaacacttgaatcaaaatgttctatgtatatagatggtaaacagaagttaccaaaatatttctaccattcatgctatttgcctcttcagtaagtatccgcctcctacctattcttaatccatttccactaatgtttctatgtctaatggttaacagtacattctgtataaacttttattccaatggttctctttattcttaaacccttgtgtcaatgatttggccagagatcaatggtcatcagaagatagttaagtagctgaagcactcttttaagatacttcagctaagcatgcttctgatttacataacaatttttaaagatccctcagtttgacataatagaacattgatctatccaaatatcagccttaacaaagtcagaactatgactgcctataacctcaccccttagcatgttgacttgattccaacataattgagattgtcaaagaacatgacaatatatactttacttcaatgatagctggaaaacagatattcttttttttctcgttttttcttaattcttaactctcatggctgaaatatatagatgattctccgcaagcagaaacatggtacactccactatctgtgagaagacaagcaaagaagcacttgagacttaagttacaccactgactgttgtttctaggggcacttctcaaccagaattttcctactcataaaatggggctaccattgtggttttgctcaccaaggaaatacagagctgaatggaaccaccactgtcatctggccctctgcccacaggcagccaaacatctgcgtggtagagagtagggctaggggacagtggcatttgaaggcacagattcaactctcagctgtgtggttttctaattgtgtaacctggagcaaataattaattgtgcaacctggagcaaataatttaaatttaataataatttaaaatctcgaaacctctttatttttcttctttttaaaaaaaaaatgtttagctctaaaatgagagtttgaataaagtaatttttaaagtccccttgctttctaagattttcatatattcagtgtgcatggttcttaaaatttttctgtaaggattgataaaataaggcttgtgcagcctttatgtctttaacaagctcaatgtgcaacctgattatctgtgacttcattgatataatcttccaatagaatattgcatttcctattgattgtttatctgtatattttggcatattgagtgacatcatttttacaactcatcaaatgggggtactctttactttgagctcccctcttcctaagtagtaggaatagtcaatgcattgtttatgaaaaatgacaagccaggaaaaaggagaggaaagaacaatgagtttccagctccactattaacttcttgctagacaagacagactgcagttacctcatctataaagaaaaaaatttaacaattcttacctacctcataagaatattgagagaattatatgagttaatatatatgtatatatgtgaagattagactccgcaaatgtaaatttttttttttttttttgaggcagagtctcactctgttgcccaggctgaagtgcaatggagcaatctcggctcactgcaacctccccctccccgagcgattctgctgcttcagctggccaagtagctgagactacaggcacccaccaccacatctgactaatttttgtatttttagcagacacagggtttcactatgttgggcgggctggtctcgaactcctgagctcaagtgatccatccgcctctgcctcccaaagtggtgagattacaggcaagagccactgtgcctggcctgcaaatgtaaattttgatgttatcttaatgattgatgtttccaccagcttctaagagagtaaacataaaaagctgtatacatggcatgtatgctaccatcttccagttaactgtctttctaaacacagcaccagacccacatgtctgtgtgttggataaactccctgcctttaatgtccataatgagcatgatacaaacattttacatcattgaaccacaaaaagcacagagtatttttccaagtttttttcctagggataattgtgaaggatcaccttccaggtgaatggctgcgaccctgtacttctagcacaaatagaactgtgttttatatactgatcctagtgaagatgtaatttcaagaaggagaatgacttattacgatgtgcattgctgagggaacaaaaacccttacttgaccca

SEQ ID NO: 535 - DNA, 6601 bp, Homo sapiens
gtgacttcttcctactttataaacaatgtgttgggggtgaccaatataaaaagaaaaagaaaatgaaatatggcttacatggttggtaattatttttatattgttatgagatagccaactcaaggttcaggatgcataaatgctgtcttgtgagttgcctaaggccttggtggtttgtctatatagcaatgtttttgaaacatggaacacctacaaagaggtagggttttcctggtatgcagcgtctcaattctgtggaatccagggacttgcatctctctgacagctttattactcaagtgtgaatggatatcctcagatgatctttttttttttttttttgagacagagtctcactctgtcgcccagcctggagtgcagtggcgcaatctcagctcactgcaagctctgcttcccgggttcatgacattttcctgcctcagcctcccgcgtagctgggactacaggcgcctgccaccacgcccggctcattttttgtatttttagtagagacggggtttcaccatgttagccaggatggtctcgatctcctgacctcatgatccgcctgcctcagcctctcaaagtgctgggattacaagcgtgagccaccgcgcccggcagatgatcatttttatcaaacaatagtgaaaacatcaaacaatagtaagaacatttgtttcaataaataatgatccccaaatatcaagattatcttaatcatccttttaatctctctgaagcagttgacagtgctgatagccctccttcttgaaactcctcccctgactgccatgactatgggtcacagtcaaaaaagtttcaaacctactgctttaaggtagaccaataagtagaaagtgacatcctaaaaaaaaaacgaagaataccagctaaggagaaattttaggcattataaatcaagtctatcccgatattcccaattctatctctgatgagttaatagaaatctaatttgatagttttagcttttatatcctatgactaatgtccaatcaactgtctgtattgtgtaactattggtctaaccgtaattcttttttaactgcatcaacctgtggcattgttataaattaaacttttttcttggtttggatttttgatcagtgaatggagtcaaactgtaacatagacataagtattagtaaaaatacggcacttactttgacctttggaagacagctgttctcagaatgattgggttattctcactgatacaattttgggttctaagttttagcccaggttcagtgtctctgacatctacacaattcaatgcagatttatttagttttttatgaagacattggttggattttttaaaagaaattcttttgaagcagaaaattgactccatgcagatttttcactctgttgcacatattaaactacaacaatttgggtgatggaaaaaagcagaaataatttgagaggcgtgggcgaaaaggccaataaggctataaaaatttcgaattacaaagagtcaagagaatattaccaaccttttattgtcagagaaatgaagagtcttacttgtgcccttgaacatgaaaggtggggttgtcagtgaatttcaagagcaattctttaaatagaggtgggtggttctcaatgagacatgagggtggtgtgaaagtggctacgaccttaaaccagtgagaactagatacacacacacacacacacacacacacacacacacacacacacacagcagaaggtagagttaaaccaatctcagttaaaatcccagctccttcacttaatagctgtgtgatcttgggcaaatcacttaacctccagtaagctagttatcttgacttgttagtatcttgggaagataataatagccttcctgagattggtcctagatgtaaataagacaatttttgtcaagtgctcatcaaagggcatggcagaaagtactagctcaatatttactgtattagtttcctagggctgctataacaaagtaccacaaattaggtggcttagaacgactgaaatgtattgtctcacagttctggaggctagaagtctaaaatcaaggtgtcagaagggtcctgctccctttgagactgtaaaggaaagatctttccttgctgtcttcaggttctggtatccccaggcattttttggtttatggcagcataactccagtcttcacatggcattctccctgtatctcttcacagagtcttcccttctgtggatattggtctctctctgtccaaattgactctttttaaaggacaccagtcatattggattagggtctaccctaatgaactcattttgacttgattacctctgtaaagaccctctttccaaataaaatcacattctgaggaactggggttagtacttcaacttatcttttgcaggggtgtgggaagaacacaactcaccctataacaattatttatgaaattatcttgctagaaatattctgcaggagatacattagtacatgaagtacttcaaaattgtagaatatcattctctagtgattcattttctgtttcttttctttttaaaggaaggagtactcagtcttttcaatggaatgacataggtatgaacttaatgagtatccttcctgcgcttagctgaatccggaaaggcaggatattgactcctttgccattctatagattcctggtcttgaggcaaagaaaactggcacaggcctttgcgactgggcctgcaaaagtatatactacacagagaaagggcatgtatccttactttgaatggtgtgctaatcgtctaacaacttcaattgtactaatcacgaatggaagagaacggctctttaatggaacttcaatgaatataaattacatacttactaatcaaaatgaatccttttcagctaatttctttttttctccttaaatgtcttgagtgagtaatataagcttttgttattttttttggccagttttctctgccataaccctgattgtaactccactctcatcatggaacttaatgcccaaacactacacattaatttctatttcttcatatgttttacaaaatgatatatatttttgccccaaactgcaacatgctatgaaggcttaatattctaacattgcaatcatgggtacaacctaaaaaaagacttcaaattagttagcaaaggaaataaaaataggactctctggggacagaatgcaggccagtaggggatacgacaccttggtgggggtttttagggctatgttgattcattcaaatgccttaatgacctcctatgacagaaccatgtggcagagaaaaaagattcatatgccaatgtgaagggagaagaagaatcaaaatgaggaggaacagattaaatatttcacaatttaacaagatgatatttaaggcacctaatttcttgccttctaaaaactgctagcaaaatgtaatttcttgatagccaaaaaaaagaattcaaatgtacaccagcctcttgttacactataaaaataaggccaggcatggtagctcacacctgtaattccagtactttgggaggccaaggtgggcagatggatcacttgaggccaggagttcgagaccagccttgtcaacatagtaaaaccccatctctactaaaaatacaaaaattagccagacggggtggcacacaccggtaatcccagttacttgggtggctgaggcacaagaatcacttgaacctgggggaatttgcagtgacctgagatcgcgccattacactccagcatgggtgacagagtgagaccctgtctcaagaaaaaaatcatgaaaaatttaactataaatccagacttcataaagcaaacatattttccctttgacagtattaagtaatttagagatttatttctaaatttagaaatttatttctaatttgtcctcaataatagtcatttctcactttgtaatttgtctttaccttggttttctaaaatagtgattaaaaacaaataattacacgtgctagggatgcacttcttaaagaaacttaattttagattcagccccattgaggacctgctgtgtttgttaagtgggcagcagtgatggatgaaggccacacggtggcactataagcaatgggctactgatgcaccttttaatcaacatctactctaaaaagtgagccagtccaagtagctttgagaaaactggaaaagtctgaggctgcaatgcagaataaagatgaataaagattacataaatgaaaataaagcagctataatcaaaaccacactctaggccatctaccaaacctaagaagccacttactgtgataaattaattacttaaaaaacaaacaaacaaacaaacataaatgcatgagagttttgctatttggtggactaaaggaaacttttttgtatgttctgggtttcttaatattttttattttgaaatacatggcactgatgaatttatcattgaactgcaagatagccagaaaactaagaattattagttcactagatatagccataacataaacaagtttagtcagcaagtctgtgtaatctgattgtttcagtcaactaagcaaggcaactgactttgacagcttagaaaagtgaccttctagatgaagagttctgaaggtgattggaagctcttatcagaagtgcatgacaaaaccgactcccaaagtagcaccaattaataaaacaaattagcaatataccttctctttaatgcactggtgctcgtatttccttctatgaaattttttctacttagcagctatcaatcaataccaaaacgattatctcttgctgtgcaattgttggacagcttgggaagcgaagtggtttatataaaaatttgaaacgtagacatgaatggaaaagaccactataatttgaaagtggcttactgctaccctgattttagactggtgcctaaggaaagagctaaaagtgatgcatagcaaactgcatgaaattgcttgctcttgtaaacagattgtagcaacagggtaagggaaaacttagactatatattaaaaatatagaatgaatacctttctcatgataccataccatattgctgaagataggggtgaatggcatacatatacttttaactgagtgaaaacaactccagaaagaaagaaaacataggttatatctgtgcctccttggagcattttcaaattataggattgtattctttatgtttttattcttgataaatttgcacctaattgtatgtttcagttcccaattaaatcaagagctccttgggatatataatgtatctgctaatttttaactcctccatggttataaaaatcatattaataaaataaaagctacacatgttaagttctcattagatgccagatattgtgataagtacagtagatagcattatatacataaacttcaccaaaaaacccccatgagattaggactaatgctctctctattaataaagagaaaacagaggtataagttaatttgccaagtactactacacactactaagtagcagagctaagttttgaattcaagaataccttctaccaaagctcccagctcgccttgtagagcagagattgaagcatggtggttaacagccacagtgcctgaggtctacccagctccaaagctgactggctttatggtctttggcaagttgcctagacattctgtgtctctatgtagttgttattataccacccagcagttcataaagtagaaattcaaaaactcttactgagaaccttccaacttctctcagctatctccaaccagttgctctaatgaacaaataaatcaattggcatttgatataattgaaatcaggtgcatatttgatttttccagtaatggtcttcaattgcttctgacagtcactgtgctgtgactattatcacttcaggtgattatagttaatatagtgcttttttttcttcaacaactctactaaaatgtctacatgtcaaatagagttggtaactgaaattaataatgtagatacatagtaaagctttcttgaaaagtgatcatttagagttctgaattttaatattactatacctcattgaaggattgacacaatttacctccagctatttcatttaatctgtgcgttgctgtgatttgaactaaaattacacaaggcaaggaacacaggcataacagaggttcctctcatcttcaggggactcattgaaacaaaaaaaaatcagtaagggataatattctcttctcacttgcaatggcattttgggcattcagcctctatatttagagaaattcattaattctttaatcagtggcatggaggcaatgcaagaattctgaactcaacgttaagaaacactattttcatccaaactttgcactgtgtatctcactgaacaagtcttttctatctgcctcagtctcttaatctgtaaaataagaggatttctattgttgaactttaaagttttaagaattgatacagtacaaagacaaaaagtgggattgcaagagttttataaattgctatgtgaagagcagaacaatgcgcaagtgcttgcatttgcttctttaaagcttacacattatgttgcagaagg

SEQ ID NO: 536 - DNA, 10798 bp, Homo sapiens
aagatctgatagcccattagatatatgtggctgtgactcagaatactcaagaaaatggctgagggaggaggagtcaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgtccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcctagcacgcagctggagatctgagaacgggcagactgcctcctcaagtgggtccctgacccctgacccccgaccagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaataataaaaagaaatgagcaaagcctctaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaatatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccatacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaatcaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgacaccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtaaactcccattcacaattgcttcagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactattgcaagaacaaaaaaccaaacaccgcatattctcactcataggtgggaattgaacaatgagatcacatggacacaggaaggggaatatcacactctggggactgtggtggggtcggggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaagaaagaaaatggcttacatgaatttctcctttttatctttaaaagcttccccctttccccaacccctttggatgtgtctatggttcaccatagcatgcatatgtcccagattgcaatcccttgctattcctgaataaacttctttttggaaagtctgtctctgctgttattttaggttgacatataaaactagtgacttcttcctactttataaacaatgtgttgggggtgaccaatataaaaagaaaaagaaaatgaaatatggcttacatggttggtaattatttttatattgttatgagatagccaactcaaggttcaggatgcataaatgctgtcttgtgagttgcctaaggccttggtggtttgtctatatagcaatgtttttgaaacatggaacacctacaaagaggtagggttttcctggtatgcagcgtctcaattctgtggaatccagggacttgcatctctctgacagctttattactcaagtgtgaatggatatcctcagatgatctttttttttttttttttgagacagagtctcactctgtcgcccagcctggagtgcagtggcgcaatctcagctcactgcaagctctgcttcccgggttcatgacattttcctgcctcagcctcccgcgtagctgggactacaggcgcctgccaccacgcccggctcattttttgtatttttagtagagacggggtttcaccatgttagccaggatggtctcgatctcctgacctcatgatccgcctgcctcagcctctcaaagtgctgggattacaagcgtgagccaccgcgcccggcagatgatcatttttatcaaacaatagtgaaaacatcaaacaatagtaagaacatttgtttcaataaataatgatccccaaatatcaagattatcttaatcatccttttaatctctctgaagcagttgacagtgctgatagccctccttcttgaaactcctcccctgactgccatgactatgggtcacagtcaaaaaagtttcaaacctactgctttaaggtagaccaataagtagaaagtgacatcctaaaaaaaaaacgaagaataccagctaaggagaaattttaggcattataaatcaagtctatcccgatattcccaattctatctctgatgagttaatagaaatctaatttgatagttttagcttttatatcctatgactaatgtccaatcaactgtctgtattgtgtaactattggtctaaccgtaattcttttttaactgcatcaacctgtggcattgttataaattaaacttttttcttggtttggatttttgatcagtgaatggagtcaaactgtaacatagacataagtattagtaaaaatacggcacttactttgacctttggaagacagctgttctcagaatgattgggttattctcactgatacaattttgggttctaagttttagcccaggttcagtgtctctgacatctacacaattcaatgcagatttatttagttttttatgaagacattggttggattttttaaaagaaattcttttgaagcagaaaattgactccatgcagatttttcactctgttgcacatattaaactacaacaatttgggtgatggaaaaaagcagaaataatttgagaggcgtgggcgaaaaggccaataaggctataaaaatttcgaattacaaagagtcaagagaatattaccaaccttttattgtcagagaaatgaagagtcttacttgtgcccttgaacatgaaaggtggggttgtcagtgaatttcaagagcaattctttaaatagaggtgggtggttctcaatgagacatgagggtggtgtgaaagtggctacgaccttaaaccagtgagaactagatacacacacacacacacacacacacacacacacacacacacacacagcagaaggtagagttaaaccaatctcagttaaaatcccagctccttcacttaatagctgtgtgatcttgggcaaatcacttaacctccagtaagctagttatcttgacttgttagtatcttgggaagataataatagccttcctgagattggtcctagatgtaaataagacaatttttgtcaagtgctcatcaaagggcatggcagaaagtactagctcaatatttactgtattagtttcctagggctgctataacaaagtaccacaaattaggtggcttagaacgactgaaatgtattgtctcacagttctggaggctagaagtctaaaatcaaggtgtcagaagggtcctgctccctttgagactgtaaaggaaagatctttccttgctgtcttcaggttctggtatccccaggcattttttggtttatggcagcataactccagtcttcacatggcattctccctgtatctcttcacagagtcttcccttctgtggatattggtctctctctgtccaaattgactctttttaaaggacaccagtcatattggattagggtctaccctaatgaactcattttgacttgattacctctgtaaagaccctctttccaaataaaatcacattctgaggaactggggttagtacttcaacttatcttttgcaggggtgtgggaagaacacaactcaccctataacaattatttatgaaattatcttgctagaaatattctgcaggagatacattagtacatgaagtacttcaaaattgtagaatatcattctctagtgattcattttctgtttcttttctttttaaaggaaggagtactcagtcttttcaatggaatgacataggtatgaacttaatgagtatccttcctgcgcttagctgaatccggaaaggcaggatattgactcctttgccattctatagattcctggtcttgaggcaaagaaaactggcacaggcctttgcgactgggcctgcaaaagtatatactacacagagaaagggcatgtatccttactttgaatggtgtgctaatcgtctaacaacttcaattgtactaatcacgaatggaagagaacggctctttaatggaacttcaatgaatataaattacatacttactaatcaaaatgaatccttttcagctaatttctttttttctccttaaatgtcttgagtgagtaatataagcttttgttattttttttggccagttttctctgccataaccctgattgtaactccactctcatcatggaacttaatgcccaaacactacacattaatttctatttcttcatatgttttacaaaatgatatatatttttgccccaaactgcaacatgctatgaaggcttaatattctaacattgcaatcatgggtacaacctaaaaaaagacttcaaattagttagcaaaggaaataaaaataggactctctggggacagaatgcaggccagtaggggatacgacaccttggtgggggtttttagggctatgttgattcattcaaatgccttaatgacctcctatgacagaaccatgtggcagagaaaaaagattcatatgccaatgtgaagggagaagaagaatcaaaatgaggaggaacagattaaatatttcacaatttaacaagatgatatttaaggcacctaatttcttgccttctaaaaactgctagcaaaatgtaatttcttgatagccaaaaaaaagaattcaaatgtacaccagcctcttgttacactataaaaataaggccaggcatggtagctcacacctgtaattccagtactttgggaggccaaggtgggcagatggatcacttgaggccaggagttcgagaccagccttgtcaacatagtaaaaccccatctctactaaaaatacaaaaattagccagacggggtggcacacaccggtaatcccagttacttgggtggctgaggcacaagaatcacttgaacctgggggaatttgcagtgacctgagatcgcgccattacactccagcatgggtgacagagtgagaccctgtctcaagaaaaaaatcatgaaaaatttaactataaatccagacttcataaagcaaacatattttccctttgacagtattaagtaatttagagatttatttctaaatttagaaatttatttctaatttgtcctcaataatagtcatttctcactttgtaatttgtctttaccttggttttctaaaatagtgattaaaaacaaataattacacgtgctagggatgcacttcttaaagaaacttaattttagattcagccccattgaggacctgctgtgtttgttaagtgggcagcagtgatggatgaaggccacacggtggcactataagcaatgggctactgatgcaccttttaatcaacatctactctaaaaagtgagccagtccaagtagctttgagaaaactggaaaagtctgaggctgcaatgcagaataaagatgaataaagattacataaatgaaaataaagcagctataatcaaaaccacactctaggccatctaccaaacctaagaagccacttactgtgataaattaattacttaaaaaacaaacaaacaaacaaacataaatgcatgagagttttgctatttggtggactaaaggaaacttttttgtatgttctgggtttcttaatattttttattttgaaatacatggcactgatgaatttatcattgaactgcaagatagccagaaaactaagaattattagttcactagatatagccataacata

SEQ ID NO: 537 - DNA, 668 bp, Homo sapiens
ctaatttcttgatatctaatatggaacagttagtcccactcttaagataacattgaaaaaaataaataaaatggagaagttaggatttataaatagcttttctctctcaaccaaatctgctgttgaaggtggtagattcactacaatttgagaaagtcaaatttaaataggaggtgctattgctgccactgagctgtcaccacaggttttaccatggacaatgctaatactgaatacttgatactctttcagaattttgttatacttgtcaatggaaactggatgtggcagccaccattctcaggataaattccaaattctacattgttccttatatcactaaattttgttcagaatccaaaatgggtacacaggattgatggagccaatgcaagtcctagttataggacaagctgtgtaaatatctgatatctattgcaaaaggtggaagacacatgattctctaaacccaaactgctaagtggccaaagcgactgtcaaatatccattatacaagtctaaaccaaggctcaattaacctactctccaaattagggcacagaatatagtcctagtcctgtcagctctccaggtgtgtccttgtggaacaagtcaaggttaccacttaaagaatggaaactgtttgtgtacccttcttacaaagaatg

SEQ ID NO: 538 - DNA, 15073 bp, Homo sapiens
aaaaagattttgaggtcattttcaaataaaacagattttttaaaggtatattatatactaggctgaattattccttctgtttagatatcaaaatgtttttatacttaatttttaaaatacaagattagccaaacttgttttaaagactatcctttagtttattttgatgtgaatgacactccatgtttaatcatctattgtttgtggcccttgtctttctgatagttatttccaaattgacaaaaggaattgcattttaaaaaatttcatgggtagcagcaatcttctgagtacatacttggacacagcaaaaggtgctagtaggaaatagagaactagttaagacgtgatttgctccctcactgcaccctccaccctcaagttgcagtgaagttgtatgctttttgtgcttcttggctgtagtgtgttaacctttatatgattattcatttttatttcacagcaaaaaagaaaaagaaaaaaaggttttgatgttagatggaaattactgatttaactcaataaccccttaagatgctattgactttattttttataggttgaagttacattatgcatcttatgaaccgactataagggtgttacatgagaaacaccacactttactgaaggagaaaatgctgacctccttggaaagagacaaagtagttgggcaggtaaagatatagtcaaagctaacttaaaatgatcttttaatcatttttttaataatacaagtagaaatactgattttgtttctgagattaattttaaaacattttcaaccaactttcatgtaaaagagatccatttggaaacattcagaaaaagtatttctccatttaactacctataaagattattataaaattaggccaggggcagtggctcatgcctgtaatcccagcactttgggagaccaaggtaggtggatcatttgcggccaggagtttgagaccagcctggccaatatggtgaaaacctgtctctactaaaaatacaaaaaaaaaaaaacaaaaaacaaatagccgggtgtggtggcacaggcctgtaatccctgctacgtgggaggctgaggcatgagaatcatttgaacccgggagtggaggttgcagtgagccgagatggccccataccactgcactctagcctaggcaacagagtgagacagtgtctcaaaaaaattaaattaaatatcatttaattgagacataaatttatagcagattattaaattatagttagaagaaaaaacttagccattgtggtcaaacttgggtttaaatgccagctttgacagctataaacattaaccttaggagagtcatttaaacaaattggagctcagatttctcatatataaaatgtagctgcaaagaccaaagacataccatttaagattgctgtgaaacttatatgagatattttaataaataaaaactccctcataggtactgactcaagtttttggttatttttgctaatgcttgacatccttttagggtttttgtgtaggcttaggcctagggtagtgggtgagatacctttggcataaaaatttaagaaaaagaaacaaaatgtttatatgccactttaaaaccatttatcagtttttttagaatatataaaactgcaactatgcttaacattctattattgttttctggagattttcatttttggccaaactttgagaagctacaaaagcttacatgatgataatactcttttgaataattttatttgtcaagacatgctttaatcaagtttattttgtcttttgagtgaaattcttagcttcgaaaatgcaaaacatcattgtcttgatgccccttgtgcttgaatttaattttgtgttttgaatgtttgaattttaagtaatattggatacaatgataatatgatttggctgtgtccccatccaaatctcaccttgaattgtaatcatccccacgtgtcaagggcgggaccaggtggaggtaactgaatcatgggggtggtttctcccatgctattctcatgataattgagtgagtctcaagagatctggtggttgtataagcgtctggcatttcttttgcttgcactcactctctttcctgccaccctctgaagaggtttctaccatggttgtaaatttcatgaggactccccagccatgtggaacttgagccaattaaacctctagtctttttttttttttaatatatttttaccctaaaacctctattctttataaaatacccagtctcgggtatttcctcatagtggtgtgagaatgaactaatacaaatgagtttaacaataatttaaattttatggcattataatcaaaccttcagaatttcatacccttgcttcttttcatctaatctgtcttccccagtctcctaacaaaaggctttctttattctatatcctgaggtattaggagctagattcagatctcttcctatttcctattccagatgggccaagcttaagcttttgctacccatcttactctctttagtcctcctggtctcatgcttatctcccatataccatgtacaatatttgtgtttcaagttgctccttgatggtttagtggaaagagctaagaactgggaatggctggtatgaattccagttgtgttgtaaaacacccaagtgaggattcaggttatttaaatatttctttttactcacttattaaatagggataaattatttgccttatgattgatatgtgtacaagattaaaacatgtttaaaaagttaaaatcatttgatctatgagttagagttgaattttgcacactactgttcagatgtgcaaagaaatatatctttattatctgcaactggttttgtctttgaactcctactcctgctgaagacaaaagaaaagataacctgcatattaaagactatcccaatctttgtgagttaaaccagtctctttgggtttaacacagggtgtttgaatattatattaactgaatgtttagctaaaacatagttattagtgctcattttcttccttcaaatggcatgccctttttattcttccccagatggttcctagtaaaaaagttacttgtctatccgtatagcttaaagtctacaggctatattcactctccagtgtactgtgacttgtttgattaggttggtgtccaggtacatgaaacctggatagttctggatagctcctggatagttcctgggtagttcttttgtatgtgaacccaacacaccttgctaaatccatggcctctgccacaatatctgtgaactcctttatatctgtggcctcattatcctaaccctagctttttttctgctccagtacatcaaatattaacatttccatgtaccccactgaggtggttgaggcttctgatttctctatattggaaatacaagccatgagcaatttgaaaaccagttagggtccatctacacagatatacctttttcagtccattttcaacatgacctggagagtagtgtgtttttctagcacaatgtaaaatatgaaggactctttaaggggttgtcaattttcctaggctattgcctgaaaagctaacagcaagtatacttatattcctggagtatccctagagtatctggctttatttgcccttcatttccaactggccccacttgcatttttcacttggtagataaagtaggactcatgtctgacctgttgttacctcgtccctcaggcatctcgtccctcaggcacagaactcttttcacttctttgttctattggatggaatatcttcctatcttctttcatgttacaggatgctctatgtcctcatttgttacagcaatcctgatttacacctatttgcacaggggaatttttaataaattccactttcaccctaaaaatatcccaatttagaaaatctttattaatgggaaaattctatttttttatactttaagttctagggtacatgtgcacaacgtacaggtttgttacataggtttacaagtgccatgttggtttgctacacccatcgtcatttacattaggtatttctcttaatgctatccctgtcccagccccacaccccatgataggccctggtgtgtgacgctccctgccctgtgtccatgtgttctcattgttcgtttcccacctatgagtgagaacatgcggtgtttggttttctgtacctgtgatagtttgctgagaatgatggtttccagcttcatccatgttcatgtcaaaggacatgaactcatccttttttatggcagcatagtattccatgatgtatatgtgccacactttcttaatccagtctatcattgatggacatttgggttggttccaagtccttgctattgtgaacggtgccgcaataaacatacatgtgcatgtatctttatcgtagcatcatttataataatttgggtatataccccgtaatgggattgctgggtcaaatggtatttctggttctagatccttgaggaatcaccacactgtcttccacagtggttgaactaatttacactcccaccaacagtgtaaaatcattcctatttctccacatcctctccagcatctgttgtttcctgactttttaatgatcgccattgcaactggtatgagatggtatctcattgtggtttttatttgcatttctctgatgaccaatgatgatgagcattttttcacgtttctgttggctgcataaatgtcttcttttgagaagtatctgttcatatactttgtttttttcttgtaaatttgttgaagttatttgtagattctgaatattagctctttgtcagatgggtagatggcaaaaattttctcccattgtgtaggttacctgttcactctgatggtagtttcttttgctgtgcagaagctctttagtttagttagatcccatttgtcaatttttgcttttgttgccattgcttttggtgttttagtcacaaagtctttgcccatgcctatgtcctaaatggtattgcctaggttctgttctagggtttttatggttttaggccttacatttaagtatttaatccatcgtgaattaatttttgtataaggtgtaaagaagggatccagtttcagttttctgcatatggctagccagttttcccagcaccatttatcaaatagggaatcctttccccatttcttgtttttgtcaggtttgtcaaagatcagatggttgtagatgtgtggtgttatttctgaggcctctgttctgttccactggtctatatatctgttttggtactggtaccatgctattttggttattgtagccttgtagtatagtttgaagtcaggtagcctgatgcttccagctttgttctttttgcttaggattgtcttggctatgcaggctcttttttggttccatatgaactttaaagtagttttctctaactctgtgaagaaagtcattggtagcttgatggggaaggcattgaatctataaattaccttgggcagtatggccattttcaagatattgattgttcctatccgtgagcatggaatgttcttccatttgtttgtgtcctcttttatttcattgagcagtggtttttagttctccttgaagacgtcctttacatcccttgtaagttggattcctaggtattttattctctttgaagcaattgtgaatgggatttcactcatgatttggccctctgtttgtctgttattggtgtataggaatgcttgtgattgttgcacattgattttgtatcctgagattttgctgaagttgcttatcagcttaaggagattttgggctgagatgatggggttttctaaacatacaatcatgtcatctgcacgcagggacaatttgactccctctttttctaatcgaatcccctttatttctttctcttgcctgattgccctggccagaactgccaacttccaactatgttgaattggagtggtgagagagggcatcgttgtcttgtgccagttttcaaagggaatgcttccagtttttgcccattcagtatgatattggctgtgggtttgtcataaatagctcttattattttgaggtattttcgatcaatacctagtttattgagagattttagcatgaagtgatgttgaattttgtcaaaggccttttctggtggataagctttttgatgtgctgctggattcggtttgccagtattttaatgaggattttcatcgatgttcatcagggatattggtctaaaattctctttttttgttgtgtctctgccaggctttggtatcaggatgatgctggcctcataaaatgagttagggaggattccctctttctctattgattggaatagtttcagaaggaatggtaccagctcctctttgtacctctggcagaatttggctgtgaatctgtctgatcttggactttatttggttggtaggttattaattattgccgcaatttcagagcctgtgattggtcaattcagagattcaacttcttcctagtttattcttgtgagagagtgtgtgtccaggaatttatccatttattctaaattttctagtttatttgcatagaggtgtttatagtattctctgatggtagtttgtatttctatgggatcggtggggatatcccctttatcatttttttattgcatctatttgattcttctctcctttcttctttattagtcttgttagtggtctgtcaatattgttgatctttcaaaaagccagctcctggctactttgattttttgaagggtgtttttgtgtccctgtctccttcagttctgttctgatcttagttatttcttgccttctgctagcttttgaatgtgtttgttcttgcttctctagttctttttattgtgatgttagggtgttgattttagatctttcctgctttctcttgcgggtatttagtgctctaaattttcctctacacactgctttaaatgtgtcccagagattctggtatgttgtgtctttgttctcattgatttcaaagaacgtctttatttctgccttaatttcgttatgtacccagtagtcattcaggagcaggttcttcagtttccatgtagttgtgtggttttgagtgagtttcttaatcctgagttccaatttgattgcactgtggtctgtggtctgagagacagtttgttgtgatttgtattcttttacatttgctgaggagtgctttacttccaattatatggtcaattttagaataagcgcgatatggtgccaagcagaatgtatattcttttgatttggggtagagagttctgtagatgtctgttaggtctgcttggtgaagagctgagttgaagtcctggatatccttgttaaccttctgtctcgttgatctgtctaatattgacagtagggtgttaaagtctcccattattattgtgtgggagtctaagtctctttataggtctctaaggacttcctttatgaatatgggttctcttgctttgggtgcatatatatttaggatagttggctcttcttgttgaattgatccctttaccattatgtaatggccttctttgtctcttttgatatttgttggttttaaagtcgttttatcagagactaggattgcaacccctgcttttttttgctttccatttgcttggtagctcttccttcatccctttattttgagcctatgtgtgtctctgcacatgagatgggtctcctgaatacagcacactgatgggtcttgactgttaatccagtttgccagtctgtgtcttttaattggggcatttagcccatttacatttaaggttaatattgttatgtgtgaattcaatcctgtcattatgatgttcgctggttattttgcccattaattgatgcagtttcttcatagcattgatggtctttacaatttggcatgtttttgcagtggctggtactggttgttcctttccatgtttagtgcttccttcaggagctcttgtaaggcaggcctggtagtaacaaaaccccttagcatttgcttgtctgtgaaggattttatttctccttcacttatgaaacttagtttggctagatatgaaattctgggttgaaaattctttcctttaagagtgtcgaatattggcccccactctcttctggcttgtagggtttctgccgagagatctgctgttagtctgatgagcttccccttttatgtaacctgccctctctctctggcggcccttaacattttttccttcatttcaaccttggtgaatctgacgattatgtgtcttagggttactcttcttggggagtacctttatggtgttctctgtatttcctgaatttgaatgttggcctgccttgctaggttggggaagttctcctggataatatcctgaagagtgttttctaacttggttccattctccccatcactttcaggtacaccaatcaaatgtagatttggtcttttcacatagtgccatatttcttggaggctttgttcatttctttttactctttttctctaatcttgtcttctcactttatttcattaagtcgatcttcaatcactgatatcctttcttccacttgattgaattggttactgaagcttgtgcatgcatcacaacgttttcgtgctgtggttttcagctccatcaggtcatttaaggtcttctctgtactgtttattatagttagccattcatctaaccttttttcaaggtttttagcttccttgcgatgggttagaccacgctcctttagcttggagaagtttgttattaccgaccttctgaagcctacttttgtcaactcatcaaagtcattctccatccagttttgttccattgctggtgaggagttgtgatcctttggaggagaagaggcactctggtttttagaattttccacttttctgctcttgtttctctccatctttgtggttttatctacctttggtgtttgatgttagtgaccttcagatggggttttgatgtgggtgtcctttttttgaagtttatgctatttctgtttgttagttttccttctaacagtcaggccccttagctgcaggtctgttggggtttgctggaggtccactccagaccctgtttgcctcgctatcaccagcagaggctgtagaacagcaaatattgcagagcagcaaatattgctgcctgatccttcttctagaagctttgtcccagaggggcacctgcctatatgaggtatcagtcggcccctactgggaggtgtctcccagtcaggctgcatggggatcagggacccacttgaggaggcagtccatccattctcagagctcgaatgccatgctgggagaaccactgctttcttcagagctgtcagacatggggtttaagtctgcagaagtttctgctgccttttgttcagctatgccctgcccacagagatggagtctatagaggcagtaggccttgctgagctgcggtgggctcctccagtttgagcttcccagctgctttgtttacctactgaagcctcagcaatggcagacgcccctcctcccaccaggctgcagcctcgcaggtcaatctcagactacagtgctagcagtgagcaaggctctgtgggcgtcggacctgctgagccaggcacgggagaaaatctcctggtctgccagttgctaagaccatgggaaaagtgcagtatttggacagaagtgcctcgtttttccaggtacagtctgttatggcttcccttggctaggaaaggcaaatcccccaaccccttgcactcctgggtgaggcaacgccctgccctgcttcagcttgccctccgtgggctgcacccactgtccaaccactcccaatgggatgaaccagcacctcagttggaaatgcagaaatctgtcttctgtgttgatcacactgggagctgcagacgggagctgttcctattcagccatcttggaaacgaccttaatttgaaaattctaaagagctaatttcttgatatctaatatggaacagttagtcccactcttaagataacattgaaaaaaataaataaaatggagaagttaggatttataaatagcttttctctctcaaccaaatctgctgttgaaggtggtagattcactacaatttgagaaagtcaaatttaaataggaggtgctattgctgccactgagctgtcaccacaggttttaccatggacaatgctaatactgaatacttgatactctttcagaattttgttatacttgtcaatggaaactggatgtggcagccaccattctcaggataaattccaaattctacattgttccttatatcactaaattttgttcagaatccaaaatgggtacacaggattgatggagccaatgcaagtcctagttataggacaagctgtgtaaatatctgatatctattgcaaaaggtggaagacacatgattctctaaacccaaactgctaagtggccaaagcgactgtcaaatatccattatacaagtctaaaccaaggctcaattaacctactctccaaattagggcacagaatatagtcctagtcctgtcagctctccaggtgtgtccttgtggaacaagtcaaggttaccacttaaagaatggaaactgtttgtgtacccttcttacaaagaatgatttattgccaaccaatcctttctttctgttgtagcatactaatcaggtatatcctgggtgtacaggcatagattagcctttgaaattgaacatattagtagtgtgtcatggagctatagaatgaatttattcaaagtatgtgtacagagaaaatatcttaaaatatgtgaaatgtttctctataatgtaaaatagaagataggttacttttgtgcttatattttgaatatttctttatttcaacgtttgatgcagttacgctttgagaattcatttccaaccaaactttaggatgtgagttaagagcagtaagacatcttatgttttctagctggattcctgattgttacttccttaaaaactttatcttaatgagcatttagcttactgtgtttctccttaaacctataccttgcataaagaaggattgtataataatttaaaatttttgattattatctagtttgcatatgaaagagtgaaaacacactgtgggatgacaaaaatccgataggaaatacatgttttcaaatttctttagtagatactagacagtgaatcaacatttatttaaaatgtaatgaaaaacctataactttgtttttggttttaagaaattattgaaaatagtgttcagaattttgaattagagctccatgacccaagaaaaggtgaaatagaattgatttgtaggtatctatgtatactaaattatattttatcttttttagatcatgggattctaactcagaatatgtatgtatgtgtgtgtgtgtgtatatatatatatatgtatactaaaaactaaatctaaatatatatatatattttaggtctgtctgcttggagagtctagaagtagtgacactccaccagtaatgaacatatccagtgttaggatcttgatttctaatatcactctgtaataaaaggaaaggaaacagggttctttggagaagtgtctgattctagagctgggcagataaaatactagataggcctggagcacttgggacattttcttgtgctagaaaggaaggaaatgctcaaaaagtagaacagaaaagaaaaaaaaactcaacataataatgggatatgtcaagttatgacaaaggaactgtagtgggcacctgcagaggttggtggatccccaactaaatttgatttggatattcagactgataatgccacacacacacacacacacacacacacacacacacacacagaggctgtgaataaattcactacttgtggaactgaatttgctgaggagagctgcacattacctcccaagcatttctgaaatggcttgagagagcaagtaagggagactggcttggggtttttattgcggttgggggttagggccagggtgagaattctcatatgtgaggtgaggcttgagtcatttgaatctcccatcagtaccagacaagggagtacccaggcattcttgtccagttgcccagatgttgggcacaagggaagaaggaggaggtaaaacttaaaggctgttgacactcaaacatcaaacaataaagtcaggttcctcattataggaatccaacctgaaagagcttccagtgatcaaaccttctgaaacaatttgagcaacaaaataatgtagtgtttgattataacccaaaatataaaataaatatctttgattccttaatggtataaatataaatgattagtaaggacatgtgagagagtagacaaatctcccatacagaagaatctcgagtaatatatgttgataatccttccctcaagtaggtggagcttaacaactcagctgttgagtgttggctgcactttgtaaataatgacttgcatccagaaatgcaagggaaatagggaagaaagtaactttacagtggggaaacctgtcaaccttctcatcatgtaaccaaaggatcaaggtgaacatcatcagttttaagtactgttggtagcatgaacctatgatgtaatatgctaataatggcactcccctgtgatcttcttgcaaatccataactttagtctaaccatggggaaaatatcagacaacctcaaatctagggctattctgtaaaatactgtcagactaatgctccccaaaattgtcaaggacattaaaatcagggaaaatctgtgtattagtccatcttgtgttgctataaaggaatacccgagactgggtaatttataaggaaaagaggtttatttggcgcatggttctgcaggctgtagaagaagtatagcaccagcatctgcagagagatctgcctccatgacccaaacacttccccctaggccccacctccaacactggggatcacttttcaacaagagatttggagaggacaaatatccaaactatatcagtctgagaaactgtctcagtccagaggaggcttaggagacctaaaaactagttgtaaggtgatattctggatgcgattttgaaacataaaaaggatattatggaaaaattaataaaactaaaaatatggcctgtagttcataataatatatcaatattggttcattatttgtgaaaaatgtatcattacaatgtatgatgttaatgggggaaaaagggtatgggataaaacaggaattctcagtactacattagcaactctcctgttaatcttatgctattctaaataaaaagtttatttttgaaatttataattcttttggcttctaggaatagatagtaatcttttacttttttttaacctaggcatttcatgagcactcatctataggttataattaataaattatgttattttctattaataaagaaatattactattcagtgatagtagaaaaaagtgtgtatctgtatgtaattgaacagatggtattttgtgttggtataatcatatacaatgcaagatgaaatagcttttcaaggtcaaattttaaattaagtatttttcaggaatacaggtaaatcatgacaccaaagctaacaaaagttcttagttataagacatgtttaataaaatagagaatatatgtgggtggaaaatgagctaagagttgggggaataaaaacaacctcttcatattttacattccaagtgataattaccttgtattttataaatataaagatgatagttattgtgaaacaatttgaacagaggaaaaacctctctcaaaatagagaattgaataattattaaagtgtacaatgagtattcttaattcaggaaactatgccgtgaaataaatgtttcagatgcttacctaaaataagtaattaataattagctggtggaattatattttaacttaaaattctgtttttcttttgttaaaatttatgttttattaaaaaaggtataaatttaaaagagattaatattttttatattttacaatggatatttaaatattgtgttttatgtaacctttttaaaagtcatttagtgtataatttcatttctttgaattttactttttagatttctggacttcaagaaacattgaagaaactgcaaagaggacatagttaccatggtcctcaaattaaaggtaaatgtaaaatgtgatgaagctctcatttaatatagtttggtgatttctcaaccttatcagtgattaatattctagagatatttaaaggtgagtaagtggtggctatttcacaaattaaaattttaataaaaagattaagaagaaatatagatatcatactgtatggattaattatagagaaaaacaagtcaactataatggaaggacttctgcttctggtcattatacctggtaccagactagccttctctgtgtaaataactctaaagctaagctgtaagatcagacaactacttttaggcagtagaaaacagacagctcaagtaacagaaggcaattgacagaaggaaaatttataaggtgagctctgccatcaccatggctttgggtctgtggaaagttccaaactgagctttgtggagatggaagccaataagagcatgacaatcctgataattggaaatgtcagagaccctagttcacagcttttgaagccactggaatctgtagggaaagacaccagagaagagagctgcaatgaggagtggctcagtttgtgagggagtttactatgagtccttagctgaggctgcaatactatacataacaacactacctgacacttacaagagagatacaattatataggatcaagaggaggccagagattgtagaagttaagtagtgatgcgaaacattgcaaatctggccatgcctgggtggaaagacctctttcacaccttgttaacaacacagtaacattcagcatcccatatccgccttataaaaccaggaacaaagcttacacagcattcttagagaggacacagaatttggagtttgagtcttgccaagttatagggccttgagaaacatttagggctttccatgga

SEQ ID NO: 539 - DNA, 1736 bp, Homo sapiens
acccacaattttaacctaaatgatttcttccaaaattccatagtttactttttagattgagccatatatggtgtactgcacaagtggattaagatattttaaggtatttttaggagtaattttgactatacttgagctaattaacgctgacgtcgaatctattccctggcaaaagtaaactccattgtattcctgttctttagtccttttggtagaaacccatttgggatattattccaacatatattatctatctatctatgatcttgctttgtacaaatacataaatagatgattcccttgcttttgatattttgggttgagtagaaattttgcccctctcatctgtccataaggttggcctcatctgtgtgcaagtctgaccattatatctgacaatggcttgagtgtctgcttttttagttttgtgctcacctcaaggcctttttagttgaacttggcctctctccatgctttggcctaaatctgagggttgccttattacaatccttcaggagacttagtgtgttattcagaaagttggatacaatgtgtttattttacgatgcatttgggcagaaatatgcctgggaagaattgaaactagattgttccttatttttgtttgtctactttgtgactcagtgcctttactacaaataatcatgacgagatcagcaagatctggttactatctaatatgatacctacagagactctctaatccaaggctttatgaaacatcaaaatgtgaaaaggatgatgaaggcttcactaagtagtgaaaatatttatacattaccacaaagtcaattgacactcaaattaaaacaactatttgccgggcgtggtggctcacattgtaatcccagtacttgggaaggccaaagcgggtggatcacctgagatcaggagtttgagaccagcctggccgatatggcgaaaccccatctgtactaaaaacataaaaaattagccgagtgttgtggcatgcacttgtagtcccagctactcaggtggctgaggcatgagaattacttgaacccaggaggcggaggttgtggtgagctgaaattgcgccactgccctctagcatgggtgccagagtgagactctgtctcaaaaacaattaaaaaaaaaaaaaaaacctgttttttagcaacagttaaaaacagcaaatattttaaaaaattgataaaaatttttttttgctatcaaataggatagaaatttaaaacatattatttaatgtggcaaagatgagcagaaacagttactttcatatactattaagtataacttagaaaaacttttgtgttaccacttgggaatattcatcagatttttaaattcatgtttcttagggccaatatttctacttctaggaagtggaatgatataggtacaggaatgtttattgcaggcatattggaaccattacatgtccaaagtgagggggaggggcgattaaatatagaacagatgcgtatatggcattaaaaattctcaaatatatcattaatcgaaaacaattctgcaaaacaatgcatatagagtgatatgttatataaaaattgatttgtgagtatatatttataaacatttacaattgcataaaaacattagcagagaataagggggattcagggaagggtgataaaggggagaagaacaaacatcaacagaggacctaattgtggcagaccgtgactatattttataacttagcagagctt

SEQ ID NO: 540 - DNA, 4568 bp, Homo sapiens
tccttctcgaaattggctttttttttttttttttttgcagttaaactaaggtgtcttttttgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtgaaatttatatatttaataagatctgtgttttaaaaattacagaaaagatatgtctggactaaacctatattcagttaggaaaatgacattggagaatatctgtagttaagagtagaacttaatacatgtatattttgtaaaattaaacttggcacatcagttttatctatgaaacaaagtcacttcttttttttttttttttgagatggagtctctctctgtcgcccaggctggagtgcagtggcgcgatcttggctcactgcaagctccgcctcccgggttcacgccattctcccgcttcagcctcccgagtagctgggactataggcgcccgccaccacgcctggctaattttttgtatttttagtagagacggggtttcaccatgttagccaggatggtctcgatctcctgacctcgtgatcctcctgccttggcctcccaaagtgctgggattacagacgtgagccaccatgccctgcagaaacaaagtcatttctatggctaaaatgttgcatattacttaggagtgcttgatacttcagatatttttcatggttccaagtttttaatagctttggttttttttccatatgggaggaaaatcgaaattagttggaattactgatacctttaattgtatggctaacatacatacagacttcagtcattttttaaaaaaataatgcaaagtaaatatgttgagaagtttgaagttagttttcgtgtttacagataggtagtttggactaacaaatacttgaaagtttgcccttttaatagttaatatgcaaaattaaacatatatttctactcctaaacattgtatctatatatgatataaaataactccaaaaggtaaaataattttcatgttatattttttacaagtgttatatactaatagaaatctgtgatcattattggttgttttgactcctattggatttttgaaatttttacttaagaaagatttaaagcataatgaggcttcaaaagagtgtactaggtattctagtaattttgcatatgtatttaattacatatgattttcataattggaaaagatcaataaaaatgttatgagctatattaattttataaataaatgtaaatatgtaaatctttcttttaacaaggtctcacatcaggaattttcaaaaatgaaacaatctaataatgaagctaacttaagagaagaagttttgaagaatttagctactgcatatgacaactttgttgaacttgtagctaatttgaaggaaggcacaaaggtatgaagtacatgcaaaaggaaccatagctagcaagtacagatgtgaacgcatagtttggaagttaagtggtatttccagttgaaccaaattgctctttgcctagaattttagctttaatgccattgctgctgcgaagtttgttataggagggagaaagcttaatgaaggtggcaacatttcatgggaactttgaagaatgaattgcatatttcaactggcagaaaaggggtataaatattccaggtagcaggaattagcagagatgtcaatgacacctttttaagggataggaagttgactaatttgatgaattttgaggggcaggagtagtcaaagctgatttgtgatggaaaagcggaggggcatgacttttatgttctctgcggtggtttgctgaggacagacttgtggcctgcccaagtgtcagaaggcttactgaatatgtaagtactttcttgccttgtcctttaaaaagtttagggaattcgcttatatttctttttaccaatttgtttttgagggaacagtgatttttaagttttttcagatgcataattccttttggtacttaacttcataataatcactgaataaagttaccttgatataaatacagtaggtaaaatgtaaaaccctctgaagagagggtgaaaatactgcaaagccttccaaatagagaggatagtaaaatgccattttaatttggtttaaaatgctttgtttaaataggtaagctgagaaaaccctccagagagcctttagaaattcttttaagggtttctgaagtatgcttgcatttctgtagtgaatttgaaaacctaatccttccacttaaataggtttaatgttattaaacaattgacttttctctaggaattaggaaggttttcatgatcatgaatcttttaacttgttacattttttatgataatgttctgtaaaaatgcttttattatttttattttctttaggagtcttagatcatatttaatattaagttgttgggcctagtaaattgtataaatgtatctcatgcagatctcagttcttcggctctaactatcattgacaaattagctttagatcacattactctctggattaaaaaattgttcttgttccttacttgtatttgttctttgcttatagttttacaatgagttgactgaaatcctggtcaggttccagaacaaatgcagtgatatagtttttgcacggaagacagaaagagatgaactcttaaagtaagtctgttttgtgtaccaaattgtacttaaagaattttcttttaaaaaatcatgtagagacttttggtatgaacttggtagtatgagatagcaattttcctcttctcatggaagaaggaactagatagagtattttacaaagcaacaagtaaacagctgcataatctgggaatgaaaggatgaaaagaagcagaaactctagatgcaggaagtacagtgaggtcacagaaatgataaaaacagttcaggtggcagatctcaggaagtgccagtaaatacaagcaatttattttgaagtggcaaataggttccttacataaaactagagctatagaacatggaggagacagcatgaatagctcagagaataccagcaaaatcactttcagaaggaggctgctgagaaagcagggccagttaacatacgactcatttcctgctgagtaatcaatacagagtagcacagtgctgataaaaggtggaaaacattaacaaaatttaataaaacttcatagatgaagaacatttaccaaaataatattgtcacagaataggtgaaaattatgagcaaacatctgaccatgagctaaacaaaaacaacaacaacaacaaatgtaaggaggcaatcattctaaggccggggtccccaatcctggggccttggactggtactggttcgtggcctgttaggcactgggctgcacagtaggaggtgggtggcagacaggcgggcagctgggcgagtattactgcctgagccccacctcctgtcagatcagccacagcattagattctcataggagcgcaaactctattgtgaactgcccgtgtaagggatctaggttgtgcattccttatgagactctgactaatgcctgatgatctgaggtggaacagtttcatcctgaaatcatcttccgctcccctgtggaaaaattgtcttccatgagaccggtccctggtgccaaaaaggttggggactgctcctctaaggaacactttgagcagaaattccagaactgcaggaatatggtaagaaaacaggaagtgataagatgtgaggtgtcagaattcaggaaagaagtagaagggaagaataaaaccgtgacatgggaaagagcacaaagggcgaataaacactaaagaacacacaggaacacagagtagaaatgaggaaattaaaatgaaaccaaagtcaagaaagaattagagagaaaatgggcacagaagatctaatataggcaaaactgaatttctctcagaagaaaaaccagatagaacagttatttaacgttctgtaaacagaacacttatttaatgatactcaagaacattttcttaagtgaagattgttgaaagaggatatcatatggtaggggaaaatgacaagaactgtcagcatcaaggcatataaattattggccttaaaagataatggcagaatcctttaggcagtcaggcaaaacagtcaagccagtttataaaaaggtgaaaaaaattaggctggcagctctgtatgccagaagagagtggagtgattgctgtaatctcaaggatagtaaatatgagctaaagattttatatcatatagtaaatacatgctaaagattttatatccagactgtcttttgggtacataaaaagccatatattcattagtaataaatataaagagctgaaagagtcttataccgatgaccctttcagccaactagatctttatt

SEQ ID NO: 541 - DNA, 1662 bp, Homo sapiens
ttggtatgaacttggtagtatgagatagcaattttcctcttctcatggaagaaggaactagatagagtattttacaaagcaacaagtaaacagctgcataatctgggaatgaaaggatgaaaagaagcagaaactctagatgcaggaagtacagtgaggtcacagaaatgataaaaacagttcaggtggcagatctcaggaagtgccagtaaatacaagcaatttattttgaagtggcaaataggttccttacataaaactagagctatagaacatggaggagacagcatgaatagctcagagaataccagcaaaatcactttcagaaggaggctgctgagaaagcagggccagttaacatacgactcatttcctgctgagtaatcaatacagagtagcacagtgctgataaaaggtggaaaacattaacaaaatttaataaaacttcatagatgaagaacatttaccaaaataatattgtcacagaataggtgaaaattatgagcaaacatctgaccatgagctaaacaaaaacaacaacaacaacaaatgtaaggaggcaatcattctaaggccggggtccccaatcctggggccttggactggtactggttcgtggcctgttaggcactgggctgcacagtaggaggtgggtggcagacaggcgggcagctgggcgagtattactgcctgagccccacctcctgtcagatcagccacagcattagattctcataggagcgcaaactctattgtgaactgcccgtgtaagggatctaggttgtgcattccttatgagactctgactaatgcctgatgatctgaggtggaacagtttcatcctgaaatcatcttccgctcccctgtggaaaaattgtcttccatgagaccggtccctggtgccaaaaaggttggggactgctcctctaaggaacactttgagcagaaattccagaactgcaggaatatggtaagaaaacaggaagtgataagatgtgaggtgtcagaattcaggaaagaagtagaagggaagaataaaaccgtgacatgggaaagagcacaaagggcgaataaacactaaagaacacacaggaacacagagtagaaatgaggaaattaaaatgaaaccaaagtcaagaaagaattagagagaaaatgggcacagaagatctaatataggcaaaactgaatttctctcagaagaaaaaccagatagaacagttatttaacgttctgtaaacagaacacttatttaatgatactcaagaacattttcttaagtgaagattgttgaaagaggatatcatatggtaggggaaaatgacaagaactgtcagcatcaaggcatataaattattggccttaaaagataatggcagaatcctttaggcagtcaggcaaaacagtcaagccagtttataaaaaggtgaaaaaaattaggctggcagctctgtatgccagaagagagtggagtgattgctgtaatctcaaggatagtaaatatgagctaaagattttatatcatatagtaaatacatgctaaagattttatatccagactgtcttttgggtacataaaaagccatatattcattagtaataaatataaagagctgaaagagtcttataccgatgaccctttcagccaactagatctttatt

SEQ ID NO: 542 - DNA, 10523 bp, Homo sapiens
aacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaagacatgctgggtttctagcactgaaatctcaagtctagacccaagatagctgtgcagtcacccaggccaggaaatccctgtgaaggcagacctcacttgttgcaggttgggtccctcagaaagcagagtctgagatgtcaactaagatatatgaggtttatgggagtcgggggagttgctcttggaatccacaactgcagaaaggaaagggagtagacaggattggacagagggagaaggtgagcagcaatgcaatttctggagcctaagctattcctacagaaagctccgaagctgagatgacctttagagttttacccagttggtctaaggggctgggcctttataccccatgtcaatcagtcatcacatgtgggccaccccaggatggggtgaggcagctctttatagctaaagcagtctccaaagtgggctgtcagctgagggctctctgccaacagcactcccatcagttgggagaataagttcttcattcccgaggtgaatctggatggcacaccatagcatccgccacaccactgcacctatttacagaagggtctggcagcccagcagcaggggtgggtgcatcttgtaaggaactgtgaagggtctgagatttacctgacttgcaagctaacaagtgagcctgccaccattttgtagcggcaggcagaagacacgggactcctggatcagagacaaagggctttattatgatgaaccatgatgaactcatggttcatcaggaagcatgagcttcatgcttgcctcattttcccttggcccccaaattccacagggtgatgcaaagtgggcccaggtggatactggcacataatagtctgtgatacaactaaatgatcccgagcatagaaaactcccaaccttgtaaagaaactgcgagcaaacctgtctaaactttgccaccaaaggagacattatcctttttattcttgtcagcaaacagataaacattctctccagtgtctctgccctggagagagacactatctttatgtctctatactttacaaacatccttgaaaagatggtctgaaacgaaagctgtcataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtggttcaacatgagaactctggtcatcttccctgcaattccttaggtcagcagtggacaatgggaacataatgtgagccacatatgtcatttaaaatattcggttgcctcattttttaaagtaaaagtaaaaataaaaataaatgattaaaattaattttaatacattttatttaatccactatatctgaaatattgtcatgtcaacgtgataaatttgaagttactaatgtggggccggatgcagtggctcacacctgtaatcccagcactttgggaagccaaggtgggcagattgcttgagcccaggagttcgagaccagcctgggcagcatggcaaaaaccgtgtctctacaaaaaattaaaaaattagctgggtgggtatgtgcctgtaatcccagctactcgggaggctgaggtgggaggattacttgagcccagaaggtggaggttgcagtaagccaagatcacaccactgcactccagcctgggcgacagagaccctgtctcaaaaaaaaaaaaaaaaagttactaatatgatattttacatttccttttttgcatgaagcttttgaaatttggtgtgcatttaacacttatagttctgggcatgcttcaagtatgcaaaggtatacatggcttgcagctactgtattggatagtgcagctctggatgtgctccacatggtgacaggacagctatagctgccccaaacatcatgtcttcacagctgtattcgaaggcagggatcagaaggtgacattgggcagagagtctctcctcacacacctcttgctcatcagggagaaaaatactggcctatccctcccctatcccacacacgcccaacaggctaccacttggtcatatggtcaattctggttgtaggaaagtctagggtagggtctggctctttcattctatctagaaggaggccagcaaggaggaagataactggggaaagttttagggcagcacagcagcgtctgcctcatctagagtacggagtggccaatcctctgagctgtatgtgcctcatcactctccctggcctgcccatggccgaaatcactgacaactcatggaaccctttaccattggatccaaatgtaacctcaaaagcccacccaacagcaggttgcaagcagtgacagtctatatgattgtcagcgtatgtgacttatatgcagactgaatttgtggactagagttaaacttcttgagagcagggccacatccttcattctctctgtggcacctacagcactgcttgtgctcaaggggaaactcaaagcagtaagaatgttttctcccttagctcagctgaacgttgcagtttctccatgaggagaaatcaaagccccttagctttgttctctgactccttaatgtccaatacaggctaggacaaccttaggcccctcgcctgtgggcctctttataaagggtcacctgttatcttttgctttattttactcatggggtctattcccaagtacttcacaaacacataattcacagggtagaaccagaacatcagctgtgtcaccctcatttggaagagcaaaggaatttatctccctaagcccttctaggcagcacagacttatcgtggactcagaagccagcaggctccttctctctggctctgacaccctgtgtaactgtccctgagccttctcagacagagctgctccagctgcaccaagagtaggccccagttgcataatcagttgttaaaatacttggcttccagctgggcgtggtgactcactcctgtaatcccagcactttcggaggccgaggcggatggatcacatgaggtcaggagttagagaccagcctggccaacatggtgaaaccccatctctactaaaaaagaaaaaaacacaaaaattagctgggtgtggtggtgcacacctgtagtcccagctacttgagaggttcaggcacgagaatcacttgaaaccaggaggtggaagcttcagttaatcaagattgcaccactgcacctccagcctgggtaacagagtgagaccctgtctcaaaaaataaaaaaacaaaacttaactttggagcaaattaaaccaaattaagaaggaatggggttggcatgagctcctacttgtgtttacttgcgagtcgcaggaaaatccgggtccttggtcttgttgtttgtctgtaagacagcgtgtgcttgcctgaagtgcatctgcatttctcaggtaagatggacagccacagggaaaactgcttagggggataaaagaagagtaagaatgtggggttgtgtttctttttggtcttttttctctgttgggctttttgtttatttattttggcttataatgcagcacattgtatatataattttgtagcttctttaaaatttctacattacaaaataaatatttcattcttaaaaatgtatgtgcataccatttttaatgactgtataatattctatctgggtagaccaggcacggtggctcatacctataatcccagcactttgggaggctgaggcgggaggatcacttgaggccaggagctggagaccagcctgggcaaacatgagacctcatctctttaaaaaaaaaaaaaaaaaaaaaaagctggcagccaagatggccaaataggaacagctcgggtctacagctcccagcatgagcaacgcagaagacgggtgatttctgcattttccatctgaggtactgggttcatctcactagggagtgccagacagtgggcacaggacagtgggtgcagtgcaccgtgcgcaagccgaagcagggcgaggcattgcctcactcgagaagtgcaaggggtcagggagttccctttcctagtcaaagaaaggggtgacagatggcacctggaaaatcgggtcactctcaccctaatactgcgcttttccgacaggcttaaaaaacggcgcaccaggagattatatcccgcacctggctcagagggtcctacgcccacggagtcttgctgattgctagcacagcagtctgagatcaaactgcaaggcggcagccaggctgggggaggggcgcctgccattgcccaggcttgcttaggtaaacaaagcagccaggaggctcgaactgggtggagcccaccacagctcaaggaggcctgcctgcctctgtaggctccacctctgggggcagggcacagacaaacaaaaagacagcagtaacctctgcagtgttaaatatccctgtctgacagctttgaagagagcagtggttctcccagcacacctctggagatctgagaatgggcagactgcctcctcaagtgggtccctgacccctgacccccgagcagcctacctgggaggcaccccccagtaggggcagattgacagcccacacggccgggtactcctctgagacaaaacttccagagaaatgatcagacagcagcattcgtggttcacgaaaatctgctgttctgcagccaccactgctgatacccaggcaaacagggtctggagtggaccgctagcaaactccaacagacctgcagctgagggtcctgtctgttagaaggaaaactaacaaacagaaagacatccgcaccaaaaacccatctgtacatcaccatcatcagagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgagttgagagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactatgtgaagaatgcagaagcctcaggagccgatgcgatcagctggaagaaagggtatcagtgatggaagatgaaatgaatgaaatgaagtgagaagggaagtttagagaaaaaagaataaaaagaaacaagcaaagcctccaggaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcactaaacatggaaaggaacaacctgtaccagccactgcaaaatcatgccaaattgtaaagaccatcgaggctaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagactcatcagtgtgctgtattcaggaaacccatctcatgtgcagagacacacataggctcaaaataaaaggatggaggaagatctaccaaacaaatggaaaacaaaaaaaggcaggggttgcaatcctagtctctgataaaacagactttaaaccaacaaagatcaaaagagacaaagaaggccattacataatggtaaagggatcagttcaacaagaagagctaactgtcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatacccagaaattgaactcagctctgcaccaagcggacctaatagacatctacagaactctccaccccaaatcaacagaatatacatttttttcagcaccacaccacacctattccaaaattgaccacatacttggaagtaaagctctcctcagcaaacgtaaaagaacagaaattataacaaactgtctctcagaccacagtgcaatcaaactagaactcaggattaagaaactcactcaaaaccactcagctgcatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagaagaactgaaggaaatacagacacaaaaaaacccttcaaaaaattaatgaattcaggagctggttttttgaaaggatcaacaaaattgatagaccactagcaagactaataaagaagaaaagagagaagaatcaaatagacgcaataaaaaatgataaaggggatatcaccaccgagcccacagaaatacaaactaccatcagagaatactgcaaacacctctacgcaaataaactagaaaatctagaagaaatggataaattcctcgacacatacaccctcccaagactaaaccaggaagaagttgaatctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcagcatcctgataccaaagccgggcagagacagaaacaaaaaagagaattttagaccaatatccttgatgagcattgatgcaaaaaccctcaataaaatactggcaaaccaaatccagcagcacatccaaaagcttatccaccatgatcaagtgggcctcatccctgagatgcaaggctggttcaatatatgcaaatcaataaatgtaatccaacatataaacagaaccaaagacaaaaaccacatgattatctcaatagatgcagaaaaggcctttgacaaaattcaacaatgcttcatgctaaaaactctcaataaattaggtattgatgggacatatctcaaaataataagagctatctatgacaaacccacagccaatatcatactgaatgggcaaaaactagaagcattccccttgaaaactggcacaagacagggatgccctctctcaccactcctattcaacgtagtgttggaagttctggccagggcaattaggcaggagaaggaaataaagggtactcagttaggaaaagaggaagtcaaattgtccctgtttgcagatgacatgattgtatatctagaaaaccccattttctcagcacaaaatctcctaaagctgataagcaacttcagcaaagtctcaggatacaaaatcaatgtacaaaaatcacaagcattcttatacaccaagaagagacagagagccaaatcatgagtgaactcccattcacaattgcttcaaagagaataaaatacttaggaatccaacttacaagggacatgaaggacctcttcaaggagaactacaaaccactgctcaatgaaataaaagaggttacaaacaaatggaagaacattccatgctcatggataggaggaatcaatatcacgaaaatggccatactgcccaaggtaatttatagattcaatgccatccccatcaagctaccaatgactttcttcacagaattggaaaatactactttaaagttcatatggaaccaaaaaagagcccgcatcgccaagtcaatcctaagccaaaagaacaaagctggaggcatcatgctacctgacttcaaactatactacaaggctacagtaatcaaaacagcatggtactggtaccaaaacagagatatagatcaatggaacagaacagagccctcagaaataatgctgcatatctacaactatctgatctttgacaaacctgagaaaaacaagaaatggggaaaggattccctatttaataaatggtgctgggaaaactggctagccatgtgtagaaagctgaaactggatcccttccttacaccttatacaaaaatcaattcaagatggattaaagacttaaatgttagacctaaaaccataaaaaccctagaggaaaacctaggcattaccattcaggacagaggcatgggcaaggacttcatgtctaaaacaccaaaagcaatggcaacagaagccaaaattgacaaatgggatctaattaaactaaagagcttctgcacagcaaacgaaactaccatcagagcgaacaggtaacctacaaaatgggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactaggtatatacccaaaggactataaatcatgctgctataaagacacatgcagacatatgtttattgcggcactattcacaatagcaaagacttggaaccaacccaaatgtctacaatgatagactagattaagaaaatgtggcacatatacaccatggaatactatgcagccataaaaaaggatgatttcatgtcctttgtagggacatggatgaaattggaaatcatcattctctgtaaactatcgcaaggacaaaaaaccaaacaccacatgttctcactcataggtgggaattgaacaatgagaacacatggacacaggaaggggaacatcacactctggggactgttgtggggtggggggagaggggagggatagcattaggagatatacctgatgctaaatgacgagttaatgagtgcagcacaccagcatggcacatgtatacatatgtaactaacctgcacattgtgcacatgtaccctaaaacttaaagtataaaaaaaaaaatctggcaaattttttgccagaactgcaatttactcgaacattttccttgccttagta

SEQ ID NO: 543 - DNA, 18458 bp, Homo sapiens
ccctgcctcatgccatatcctatatcaagatcacttgggaatttatttccagattcttatattaagtacatttaatattatattggcttttattcacacttacctatgagtctgcctgcctgcctgcctgcctgcctgcctgcctgccttccttccttccttcctctgtttgttactttgtcttttttttttttttaacttcctgacatttcggttgggtgcagtagctcacgcctgtaatcccagcactttgggaggccaaggtaggcggattatgaggtcaggagatcgagatcatcctggcctagagggtgaaaccccgtctctactaaaatacaaaaaaaaaaagaaaatagctgggcatggtggcgcacgcctgtagtcccagctactcgggaggctgaggcaggggaatagcttgaacttgggaggcggaggttgcagtgagctgttgcagtgagccgagatcgcaccactgcactccagcctggcaacagagcaagactccatctcaaaacaaaaaacaaaaaaaaacaaacttcttcttctttctcctttatttctatgctgaggttttgttttgttttgtttaagacaaggtctctgttgtccagcctggagtgcagtggcgtagtcatggctcactgcagcctcgacctcctagactcaggtgatcttcccacccccacctcagcctcccggatagctgggactacaggcacacaccaccacacctggctaatttttgtagatatagggtttcgccatgttgcccaggctgaactcgaactcctgggctcaagtgatcccacccacttcaccctcccaaagtactaggattacaggcatgaatcctagtgctaggattaccgcacccaggctgtatggtagttttgttggaatatacaacctaaataaatattttaagagagaattcaataggtgatggttttgaggcctgacatgtccaacaaggcctttgtttcatcctcccaaatactggctgggtaaaagactctatgttcaaaatacttttcctgagaactgtgaagatactcttccataatcttctggccttcagggttgctgatgagaagtatggggtctgcttcataattcttttgtggaagtgggaaaggagtttccctttagggacttcactgccatcctgcactgtgttttgttttattctttttccctttctgtgcttgccaaagggtacctgggccactgccctgctctgccctccaaaaccaaagcccgagccaaatcttagctcaccagtccctacccagagggatactaaccacttcatttggagatatcttctccccatctgggtctggggatgactgtcttgtgtagccagtctgcgagtatgagtggagatggaaccagagtcttttgattagtttctctgctgtccaccccaccaccattccagtccctcatccattctgctctgagctgggattttctagcatttggttaggaaaactggtcctcacatcttcagagggcccttcttcactcctggtggtggtggtgtttgtatatctgacgctactacctaccttccctagaaattgctcattgtttcttgcccaccaatggcaaccttccccctgctactcatttgcttggtgagtaattattgagtgccccctgtatgccagatggtgtgctaggcaccatggttatagtggtgacccggagagacacagtatctggcctcgtggactttacagctcagcaaaagagggatcttaaaccaataatcactgaaatatatgggcacaagttgggaaaagtgctctgaggaaaagcagatggtgctgagcgctaaggagggcctcctgagcaagtgatggtcttaggtgcatcttagctgaggagaagggaacaggcatgtgaagagtggaaagaacattccatacagtgaaaaggctctgaggcagaatgagtggagagaagaccaggctgtccagaatgtggtgaacgaggggagagaggaggggcaggcagacccttccccatcatatgtcgaggttacccgacctattccatgaaaggcacaaccacaaagagaaagacaagctgggtcctgctggagacaagcctgcacttgccatttttttgttttgttttgtaattttattgaggtacaatctatatgacataaaaatcatccattttaagtgtccaattcattgatttttcataaatgtactgaattgtgcaaccatcactataatccagttttagaacagtttgccaccccagtgagatccttcgtggtgtttttggttaacgtcttcacttgcaacatgcactaatgtgaagtgacctttcccttctaggtcttgcaggtggaacagatgtgcccttttcagaggttgtgaagttagctccaaatcccagactagctgctaccccaagcccgggagcttctcaggtgagagaccatcggaatttgtttgtagcatttgcattatgaaagcccgctagggttttttcccccaccaaaaggtcacctacattgaacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaagacatgctgggtttctagcactgaaatctcaagtctagacccaagatagctgtgcagtcacccaggccaggaaatccctgtgaaggcagacctcacttgttgcaggttgggtccctcagaaagcagagtctgagatgtcaactaagatatatgaggtttatgggagtcgggggagttgctcttggaatccacaactgcagaaaggaaagggagtagacaggattggacagagggagaaggtgagcagcaatgcaatttctggagcctaagctattcctacagaaagctccgaagctgagatgacctttagagttttacccagttggtctaaggggctgggcctttataccccatgtcaatcagtcatcacatgtgggccaccccaggatggggtgaggcagctctttatagctaaagcagtctccaaagtgggctgtcagctgagggctctctgccaacagcactcccatcagttgggagaataagttcttcattcccgaggtgaatctggatggcacaccatagcatccgccacaccactgcacctatttacagaagggtctggcagcccagcagcaggggtgggtgcatcttgtaaggaactgtgaagggtctgagatttacctgacttgcaagctaacaagtgagcctgccaccattttgtagcggcaggcagaagacacgggactcctggatcagagacaaagggctttattatgatgaaccatgatgaactcatggttcatcaggaagcatgagcttcatgcttgcctcattttcccttggcccccaaattccacagggtgatgcaaagtgggcccaggtggatactggcacataatagtctgtgatacaactaaatgatcccgagcatagaaaactcccaaccttgtaaagaaactgcgagcaaacctgtctaaactttgccaccaaaggagacattatcctttttattcttgtcagcaaacagataaacattctctccagtgtctctgccctggagagagacactatctttatgtctctatactttacaaacatccttgaaaagatggtctgaaacgaaagctgtcataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtggttcaacatgagaactctggtcatcttccctgcaattccttaggtcagcagtggacaatgggaacataatgtgagccacatatgtcatttaaaatattcggttgcctcattttttaaagtaaaagtaaaaataaaaataaatgattaaaattaattttaatacattttatttaatccactatatctgaaatattgtcatgtcaacgtgataaatttgaagttactaatgtggggccggatgcagtggctcacacctgtaatcccagcactttgggaagccaaggtgggcagattgcttgagcccaggagttcgagaccagcctgggcagcatggcaaaaaccgtgtctctacaaaaaattaaaaaattagctgggtgggtatgtgcctgtaatcccagctactcgggaggctgaggtgggaggattacttgagcccagaaggtggaggttgcagtaagccaagatcacaccactgcactccagcctgggcgacagagaccctgtctcaaaaaaaaaaaaaaaaagttactaatatgatattttacatttccttttttgcatgaagcttttgaaatttggtgtgcatttaacacttatagttctgggcatgcttcaagtatgcaaaggtatacatggcttgcagctactgtattggatagtgcagctctggatgtgctccacatggtgacaggacagctatagctgccccaaacatcatgtcttcacagctgtattcgaaggcagggatcagaaggtgacattgggcagagagtctctcctcacacacctcttgctcatcagggagaaaaatactggcctatccctcccctatcccacacacgcccaacaggctaccacttggtcatatggtcaattctggttgtaggaaagtctagggtagggtctggctctttcattctatctagaaggaggccagcaaggaggaagataactggggaaagttttagggcagcacagcagcgtctgcctcatctagagtacggagtggccaatcctctgagctgtatgtgcctcatcactctccctggcctgcccatggccgaaatcactgacaactcatggaaccctttaccattggatccaaatgtaacctcaaaagcccacccaacagcaggttgcaagcagtgacagtctatatgattgtcagcgtatgtgacttatatgcagactgaatttgtggactagagttaaacttcttgagagcagggccacatccttcattctctctgtggcacctacagcactgcttgtgctcaaggggaaactcaaagcagtaagaatgttttctcccttagctcagctgaacgttgcagtttctccatgaggagaaatcaaagccccttagctttgttctctgactccttaatgtccaatacaggctaggacaaccttaggcccctcgcctgtgggcctctttataaagggtcacctgttatcttttgctttattttactcatggggtctattcccaagtacttcacaaacacataattcacagggtagaaccagaacatcagctgtgtcaccctcatttggaagagcaaaggaatttatctccctaagcccttctaggcagcacagacttatcgtggactcagaagccagcaggctccttctctctggctctgacaccctgtgtaactgtccctgagccttctcagacagagctgctccagctgcaccaagagtaggccccagttgcataatcagttgttaaaatacttggcttccagctgggcgtggtgactcactcctgtaatcccagcactttcggaggccgaggcggatggatcacatgaggtcaggagttagagaccagcctggccaacatggtgaaaccccatctctactaaaaaagaaaaaaacacaaaaattagctgggtgtggtggtgcacacctgtagtcccagctacttgagaggttcaggcacgagaatcacttgaaaccaggaggtggaagcttcagttaatcaagattgcaccactgcacctccagcctgggtaacagagtgagaccctgtctcaaaaaataaaaaaacaaaacttaactttggagcaaattaaaccaaattaagaaggaatggggttggcatgagctcctacttgtgtttacttgcgagtcgcaggaaaatccgggtccttggtcttgttgtttgtctgtaagacagcgtgtgcttgcctgaagtgcatctgcatttctcaggtaagatggacagccacagggaaaactgcttagggggataaaagaagagtaagaatgtggggttgtgtttctttttggtcttttttctctgttgggctttttgtttatttattttggcttataatgcagcacattgtatatataattttgtagcttctttaaaatttctacattacaaaataaatatttcattcttaaaaatgtatgtgcataccatttttaatgactgtataatattctatctgggtagaccaggcacggtggctcatacctataatcccagcactttgggaggctgaggcgggaggatcacttgaggccaggagctggagaccagcctgggcaaacatgagacctcatctctttaaaaaaaaaaaaaaaaaaaaaaagctggcagccaagatggccaaataggaacagctcgggtctacagctcccagcatgagcaacgcagaagacgggtgatttctgcattttccatctgaggtactgggttcatctcactagggagtgccagacagtgggcacaggacagtgggtgcagtgcaccgtgcgcaagccgaagcagggcgaggcattgcctcactcgagaagtgcaaggggtcagggagttccctttcctagtcaaagaaaggggtgacagatggcacctggaaaatcgggtcactctcaccctaatactgcgcttttccgacaggcttaaaaaacggcgcaccaggagattatatcccgcacctggctcagagggtcctacgcccacggagtcttgctgattgctagcacagcagtctgagatcaaactgcaaggcggcagccaggctgggggaggggcgcctgccattgcccaggcttgcttaggtaaacaaagcagccaggaggctcgaactgggtggagcccaccacagctcaaggaggcctgcctgcctctgtaggctccacctctgggggcagggcacagacaaacaaaaagacagcagtaacctctgcagtgttaaatatccctgtctgacagctttgaagagagcagtggttctcccagcacacctctggagatctgagaatgggcagactgcctcctcaagtgggtccctgacccctgacccccgagcagcctacctgggaggcaccccccagtaggggcagattgacagcccacacggccgggtactcctctgagacaaaacttccagagaaatgatcagacagcagcattcgtggttcacgaaaatctgctgttctgcagccaccactgctgatacccaggcaaacagggtctggagtggaccgctagcaaactccaacagacctgcagctgagggtcctgtctgttagaaggaaaactaacaaacagaaagacatccgcaccaaaaacccatctgtacatcaccatcatcagagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgagttgagagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactatgtgaagaatgcagaagcctcaggagccgatgcgatcagctggaagaaagggtatcagtgatggaagatgaaatgaatgaaatgaagtgagaagggaagtttagagaaaaaagaataaaaagaaacaagcaaagcctccaggaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcactaaacatggaaaggaacaacctgtaccagccactgcaaaatcatgccaaattgtaaagaccatcgaggctaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagactcatcagtgtgctgtattcaggaaacccatctcatgtgcagagacacacataggctcaaaataaaaggatggaggaagatctaccaaacaaatggaaaacaaaaaaaggcaggggttgcaatcctagtctctgataaaacagactttaaaccaacaaagatcaaaagagacaaagaaggccattacataatggtaaagggatcagttcaacaagaagagctaactgtcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatacccagaaattgaactcagctctgcaccaagcggacctaatagacatctacagaactctccaccccaaatcaacagaatatacatttttttcagcaccacaccacacctattccaaaattgaccacatacttggaagtaaagctctcctcagcaaacgtaaaagaacagaaattataacaaactgtctctcagaccacagtgcaatcaaactagaactcaggattaagaaactcactcaaaaccactcagctgcatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagaagaactgaaggaaatacagacacaaaaaaacccttcaaaaaattaatgaattcaggagctggttttttgaaaggatcaacaaaattgatagaccactagcaagactaataaagaagaaaagagagaagaatcaaatagacgcaataaaaaatgataaaggggatatcaccaccgagcccacagaaatacaaactaccatcagagaatactgcaaacacctctacgcaaataaactagaaaatctagaagaaatggataaattcctcgacacatacaccctcccaagactaaaccaggaagaagttgaatctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcagcatcctgataccaaagccgggcagagacagaaacaaaaaagagaattttagaccaatatccttgatgagcattgatgcaaaaaccctcaataaaatactggcaaaccaaatccagcagcacatccaaaagcttatccaccatgatcaagtgggcctcatccctgagatgcaaggctggttcaatatatgcaaatcaataaatgtaatccaacatataaacagaaccaaagacaaaaaccacatgattatctcaatagatgcagaaaaggcctttgacaaaattcaacaatgcttcatgctaaaaactctcaataaattaggtattgatgggacatatctcaaaataataagagctatctatgacaaacccacagccaatatcatactgaatgggcaaaaactagaagcattccccttgaaaactggcacaagacagggatgccctctctcaccactcctattcaacgtagtgttggaagttctggccagggcaattaggcaggagaaggaaataaagggtactcagttaggaaaagaggaagtcaaattgtccctgtttgcagatgacatgattgtatatctagaaaaccccattttctcagcacaaaatctcctaaagctgataagcaacttcagcaaagtctcaggatacaaaatcaatgtacaaaaatcacaagcattcttatacaccaagaagagacagagagccaaatcatgagtgaactcccattcacaattgcttcaaagagaataaaatacttaggaatccaacttacaagggacatgaaggacctcttcaaggagaactacaaaccactgctcaatgaaataaaagaggttacaaacaaatggaagaacattccatgctcatggataggaggaatcaatatcacgaaaatggccatactgcccaaggtaatttatagattcaatgccatccccatcaagctaccaatgactttcttcacagaattggaaaatactactttaaagttcatatggaaccaaaaaagagcccgcatcgccaagtcaatcctaagccaaaagaacaaagctggaggcatcatgctacctgacttcaaactatactacaaggctacagtaatcaaaacagcatggtactggtaccaaaacagagatatagatcaatggaacagaacagagccctcagaaataatgctgcatatctacaactatctgatctttgacaaacctgagaaaaacaagaaatggggaaaggattccctatttaataaatggtgctgggaaaactggctagccatgtgtagaaagctgaaactggatcccttccttacaccttatacaaaaatcaattcaagatggattaaagacttaaatgttagacctaaaaccataaaaaccctagaggaaaacctaggcattaccattcaggacagaggcatgggcaaggacttcatgtctaaaacaccaaaagcaatggcaacagaagccaaaattgacaaatgggatctaattaaactaaagagcttctgcacagcaaacgaaactaccatcagagcgaacaggtaacctacaaaatgggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactaggtatatacccaaaggactataaatcatgctgctataaagacacatgcagacatatgtttattgcggcactattcacaatagcaaagacttggaaccaacccaaatgtctacaatgatagactagattaagaaaatgtggcacatatacaccatggaatactatgcagccataaaaaaggatgatttcatgtcctttgtagggacatggatgaaattggaaatcatcattctctgtaaactatcgcaaggacaaaaaaccaaacaccacatgttctcactcataggtgggaattgaacaatgagaacacatggacacaggaaggggaacatcacactctggggactgttgtggggtggggggagaggggagggatagcattaggagatatacctgatgctaaatgacgagttaatgagtgcagcacaccagcatggcacatgtatacatatgtaactaacctgcacattgtgcacatgtaccctaaaacttaaagtataaaaaaaaaaatctggcaaattttttgccagaactgcaatttactcgaacattttccttgccttagtacagttgcttttagtttttcaattataattaagtcttcttagataaaggatttaaaaaaaaaaaaaaccctttcctattctacatgagaatttgacctttggttaactttctagctctgttttccttgagatctcataaaagtggactatcaacggttttactaggcaacattgcttatgtaaaaatggcctttgcttgggaaactgcatctgaactgagaaaaccataactacctggtgagaagtcttcctcagggcctccttgagtgcagtgactcctcctggtcctgcctcctacctactaagttgttacaggagatacttttgtagggcatatgaggttttgaagccagggtcattcttttgtctgtatgatgtggatctcaactctttttttttttttttcttttttttgagacagagtcttgctctgtcacccaggctggagtgcagtggtgcaatcttggctcactgcaacccccggctcccaggttcaagtgattctcctacctcagcctctcgagtagttgggattacaggcacctgccaccacacccagctaatttttgtatttttagtagagacggggtttcaccaggttggtcaggctggtctcaaactcctggcctcaggtgatccacccgccttggcctcccaaagtgctgggattgcaggcatgagctaccatgcccggccagatctcaactgtttgtgcctgggctgtaacctggttgggaggcaaagagaccctctcctggacagctgtgtgaactgctgtatggactgctacatggtcttccattgagaggagcacctcctgccactgtgtttctccaggctgtcttcccttggctcatggtggtcttataagtctgaatgtttagtggtatcaaagaagacccttggtggacttggcatcctacatttaggattatttccttaggagagcttcaccaaagtagaataactgggtcccatactatgggctccttaatacagatataaagtcaagtctatttcccaaagagttgtatcaccagctttcaccagctgtgcaatgaggcagccatttctaggtactctcaccagaatttttttgaaattttgtagatttgatcataaaaattggtttcttgtcataatttacagttttaaaaaatcttaaactgtaggtttgagaactgctagcatttcctcttttgtgaattgatgctttctttcgcccagaaaaaaagttaaattgcaagtaaacgggatttaaaaattttaaattgcaaagtgcaaccagatgtaagaggcattttccccctctgttctaaactgctttttctgcccttctaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccacaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatacgcatgttctcacccagagtgacaaaatcctgcagataggtttaagacctagtggctcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccgaagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttggaaaacaaaagaaaaccttaaactttatcttgaaagggtctatcttgttacttagaatattgaaccagaatgattagctctgagacatagcctaccaactatactttgaagccaaagaaaaagaactatgtaagcctctaggccaaaagacctagtctcttacaaaggaaagacctggttggcctcaaacttctcaacaaagcaagatagcaatggggcaaccttttcaagaaactcaaagtatgaactgaggatttcatatttcaccaagctgtcctttaagtatcaaggatataggaagaagttttaattacacaagagcccagggactattatactcacaacttcttccttagaattctactaaaagacaagcttcatccaactagatgattggggaaacttgagcaaaaggactggacatgaccattgaatatctttgtagatctgaggccaaatggaagtggggataagggtggaagaaccgtattagtcccttctcacactggtataaagatagtacccagctgggaatggtggctcatgtctgtaatcccagcactttgggaggctgaggcaggaagatcacctgaggtcaggagctcgagaccagactggccaacatggtgaaaccccgtctttactaaaaatacaaaaattagctgggtatggtggtgcacgcctgtaatcccagctacttgggaggctgaggcacgagaattgcttgaacccgggggcagagattgcagtgagccgagattgtgccacttcactccagcctgggcaacagtgagactctgtctcaaaaaaataataaagatagtacccaagactgggtaatttataaagaaaagaggtttaattgactcacagttccacatggctggggaggcctcaggaaacctacaatcgtggcaggaggtgaaggggaagaaaggaccttcttcacatggtggcaagaaagagagagcatggacgcacaagagagcaagcagggaaaactgtcttataaaaccatcagatctcgtgagaactctctatcatgagaacagcttgggggaaaccacccccatgatccagtcacctctcaccaggtctcgccctcaacacctggggattacaattcaagatgagatttgggtggggacagaaagcctaatcacatgaaatagtatcaaactatatatgctttgacaagacagaagtaacaaaacaaaaaagaagggagagaggaagaggaaaatacaaagaactccttgttgcttaggcaatatgtagaagtcaaatagtattatttaaagttgacaaaccaagtatatgaagtgtaagtaaggaaaaagggagatttagagcattaaaggtgtactatactattaatagtatagaatacatagtataattactagaataaaaatgtaaatcatcaatgctcaaagaagcaataataaagattacagtgaaaaacatgcagtaaatgtaccatcatacagtaaatatattaagtccaagcatataagttaaatcagtacatgtgaaaggacttacctattaaaaggaatatcagattggcttacaaaccaatgtcttattgtctgttatttataagagacacatctaaagtaagtgattcaggagaggctaaaaaaaaagagatgggcaaaaatagaccagacaagtaggaccacaaaaggcaaagattacagtatccatatctgaaaaggtagaattcaggaaaaaatagacaagacaatgaaggatacattaaaatgctaaaagccacaattcacaaggaggatatactatttatgagtgttagagcttcagttatctggtttgtcaactttaagtgatattctttggctcctgcctatcccctgtacaacaaagagctctttctactttcctctttctctctccctcctttttcattgtttccgttgtgttacttctgccttgtcaaagcacataacatttgcataacaaattatgcaaggaaaaatgaatagaaaccta

SEQ ID NO: 544 - DNA, 13065 bp, Homo sapiens
ccctgcctcatgccatatcctatatcaagatcacttgggaatttatttccagattcttatattaagtacatttaatattatattggcttttattcacacttacctatgagtctgcctgcctgcctgcctgcctgcctgcctgcctgccttccttccttccttcctctgtttgttactttgtcttttttttttttttaacttcctgacatttcggttgggtgcagtagctcacgcctgtaatcccagcactttgggaggccaaggtaggcggattatgaggtcaggagatcgagatcatcctggcctagagggtgaaaccccgtctctactaaaatacaaaaaaaaaaagaaaatagctgggcatggtggcgcacgcctgtagtcccagctactcgggaggctgaggcaggggaatagcttgaacttgggaggcggaggttgcagtgagctgttgcagtgagccgagatcgcaccactgcactccagcctggcaacagagcaagactccatctcaaaacaaaaaacaaaaaaaaacaaacttcttcttctttctcctttatttctatgctgaggttttgttttgttttgtttaagacaaggtctctgttgtccagcctggagtgcagtggcgtagtcatggctcactgcagcctcgacctcctagactcaggtgatcttcccacccccacctcagcctcccggatagctgggactacaggcacacaccaccacacctggctaatttttgtagatatagggtttcgccatgttgcccaggctgaactcgaactcctgggctcaagtgatcccacccacttcaccctcccaaagtactaggattacaggcatgaatcctagtgctaggattaccgcacccaggctgtatggtagttttgttggaatatacaacctaaataaatattttaagagagaattcaataggtgatggttttgaggcctgacatgtccaacaaggcctttgtttcatcctcccaaatactggctgggtaaaagactctatgttcaaaatacttttcctgagaactgtgaagatactcttccataatcttctggccttcagggttgctgatgagaagtatggggtctgcttcataattcttttgtggaagtgggaaaggagtttccctttagggacttcactgccatcctgcactgtgttttgttttattctttttccctttctgtgcttgccaaagggtacctgggccactgccctgctctgccctccaaaaccaaagcccgagccaaatcttagctcaccagtccctacccagagggatactaaccacttcatttggagatatcttctccccatctgggtctggggatgactgtcttgtgtagccagtctgcgagtatgagtggagatggaaccagagtcttttgattagtttctctgctgtccaccccaccaccattccagtccctcatccattctgctctgagctgggattttctagcatttggttaggaaaactggtcctcacatcttcagagggcccttcttcactcctggtggtggtggtgtttgtatatctgacgctactacctaccttccctagaaattgctcattgtttcttgcccaccaatggcaaccttccccctgctactcatttgcttggtgagtaattattgagtgccccctgtatgccagatggtgtgctaggcaccatggttatagtggtgacccggagagacacagtatctggcctcgtggactttacagctcagcaaaagagggatcttaaaccaataatcactgaaatatatgggcacaagttgggaaaagtgctctgaggaaaagcagatggtgctgagcgctaaggagggcctcctgagcaagtgatggtcttaggtgcatcttagctgaggagaagggaacaggcatgtgaagagtggaaagaacattccatacagtgaaaaggctctgaggcagaatgagtggagagaagaccaggctgtccagaatgtggtgaacgaggggagagaggaggggcaggcagacccttccccatcatatgtcgaggttacccgacctattccatgaaaggcacaaccacaaagagaaagacaagctgggtcctgctggagacaagcctgcacttgccatttttttgttttgttttgtaattttattgaggtacaatctatatgacataaaaatcatccattttaagtgtccaattcattgatttttcataaatgtactgaattgtgcaaccatcactataatccagttttagaacagtttgccaccccagtgagatccttcgtggtgtttttggttaacgtcttcacttgcaacatgcactaatgtgaagtgacctttcccttctaggtcttgcaggtggaacagatgtgcccttttcagaggttgtgaagttagctccaaatcccagactagctgctaccccaagcccgggagcttctcaggtgagagaccatcggaatttgtttgtagcatttgcattatgaaagcccgctagggttttttcccccaccaaaaggtcacctacattgaacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaagacatgctgggtttctagcactgaaatctcaagtctagacccaagatagctgtgcagtcacccaggccaggaaatccctgtgaaggcagacctcacttgttgcaggttgggtccctcagaaagcagagtctgagatgtcaactaagatatatgaggtttatgggagtcgggggagttgctcttggaatccacaactgcagaaaggaaagggagtagacaggattggacagagggagaaggtgagcagcaatgcaatttctggagcctaagctattcctacagaaagctccgaagctgagatgacctttagagttttacccagttggtctaaggggctgggcctttataccccatgtcaatcagtcatcacatgtgggccaccccaggatggggtgaggcagctctttatagctaaagcagtctccaaagtgggctgtcagctgagggctctctgccaacagcactcccatcagttgggagaataagttcttcattcccgaggtgaatctggatggcacaccatagcatccgccacaccactgcacctatttacagaagggtctggcagcccagcagcaggggtgggtgcatcttgtaaggaactgtgaagggtctgagatttacctgacttgcaagctaacaagtgagcctgccaccattttgtagcggcaggcagaagacacgggactcctggatcagagacaaagggctttattatgatgaaccatgatgaactcatggttcatcaggaagcatgagcttcatgcttgcctcattttcccttggcccccaaattccacagggtgatgcaaagtgggcccaggtggatactggcacataatagtctgtgatacaactaaatgatcccgagcatagaaaactcccaaccttgtaaagaaactgcgagcaaacctgtctaaactttgccaccaaaggagacattatcctttttattcttgtcagcaaacagataaacattctctccagtgtctctgccctggagagagacactatctttatgtctctatactttacaaacatccttgaaaagatggtctgaaacgaaagctgtcataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtggttcaacatgagaactctggtcatcttccctgcaattccttaggtcagcagtggacaatgggaacataatgtgagccacatatgtcatttaaaatattcggttgcctcattttttaaagtaaaagtaaaaataaaaataaatgattaaaattaattttaatacattttatttaatccactatatctgaaatattgtcatgtcaacgtgataaatttgaagttactaatgtggggccggatgcagtggctcacacctgtaatcccagcactttgggaagccaaggtgggcagattgcttgagcccaggagttcgagaccagcctgggcagcatggcaaaaaccgtgtctctacaaaaaattaaaaaattagctgggtgggtatgtgcctgtaatcccagctactcgggaggctgaggtgggaggattacttgagcccagaaggtggaggttgcagtaagccaagatcacaccactgcactccagcctgggcgacagagaccctgtctcaaaaaaaaaaaaaaaaagttactaatatgatattttacatttccttttttgcatgaagcttttgaaatttggtgtgcatttaacacttatagttctgggcatgcttcaagtatgcaaaggtatacatggcttgcagctactgtattggatagtgcagctctggatgtgctccacatggtgacaggacagctatagctgccccaaacatcatgtcttcacagctgtattcgaaggcagggatcagaaggtgacattgggcagagagtctctcctcacacacctcttgctcatcagggagaaaaatactggcctatccctcccctatcccacacacgcccaacaggctaccacttggtcatatggtcaattctggttgtaggaaagtctagggtagggtctggctctttcattctatctagaaggaggccagcaaggaggaagataactggggaaagttttagggcagcacagcagcgtctgcctcatctagagtacggagtggccaatcctctgagctgtatgtgcctcatcactctccctggcctgcccatggccgaaatcactgacaactcatggaaccctttaccattggatccaaatgtaacctcaaaagcccacccaacagcaggttgcaagcagtgacagtctatatgattgtcagcgtatgtgacttatatgcagactgaatttgtggactagagttaaacttcttgagagcagggccacatccttcattctctctgtggcacctacagcactgcttgtgctcaaggggaaactcaaagcagtaagaatgttttctcccttagctcagctgaacgttgcagtttctccatgaggagaaatcaaagccccttagctttgttctctgactccttaatgtccaatacaggctaggacaaccttaggcccctcgcctgtgggcctctttataaagggtcacctgttatcttttgctttattttactcatggggtctattcccaagtacttcacaaacacataattcacagggtagaaccagaacatcagctgtgtcaccctcatttggaagagcaaaggaatttatctccctaagcccttctaggcagcacagacttatcgtggactcagaagccagcaggctccttctctctggctctgacaccctgtgtaactgtccctgagccttctcagacagagctgctccagctgcaccaagagtaggccccagttgcataatcagttgttaaaatacttggcttccagctgggcgtggtgactcactcctgtaatcccagcactttcggaggccgaggcggatggatcacatgaggtcaggagttagagaccagcctggccaacatggtgaaaccccatctctactaaaaaagaaaaaaacacaaaaattagctgggtgtggtggtgcacacctgtagtcccagctacttgagaggttcaggcacgagaatcacttgaaaccaggaggtggaagcttcagttaatcaagattgcaccactgcacctccagcctgggtaacagagtgagaccctgtctcaaaaaataaaaaaacaaaacttaactttggagcaaattaaaccaaattaagaaggaatggggttggcatgagctcctacttgtgtttacttgcgagtcgcaggaaaatccgggtccttggtcttgttgtttgtctgtaagacagcgtgtgcttgcctgaagtgcatctgcatttctcaggtaagatggacagccacagggaaaactgcttagggggataaaagaagagtaagaatgtggggttgtgtttctttttggtcttttttctctgttgggctttttgtttatttattttggcttataatgcagcacattgtatatataattttgtagcttctttaaaatttctacattacaaaataaatatttcattcttaaaaatgtatgtgcataccatttttaatgactgtataatattctatctgggtagaccaggcacggtggctcatacctataatcccagcactttgggaggctgaggcgggaggatcacttgaggccaggagctggagaccagcctgggcaaacatgagacctcatctctttaaaaaaaaaaaaaaaaaaaaaaagctggcagccaagatggccaaataggaacagctcgggtctacagctcccagcatgagcaacgcagaagacgggtgatttctgcattttccatctgaggtactgggttcatctcactagggagtgccagacagtgggcacaggacagtgggtgcagtgcaccgtgcgcaagccgaagcagggcgaggcattgcctcactcgagaagtgcaaggggtcagggagttccctttcctagtcaaagaaaggggtgacagatggcacctggaaaatcgggtcactctcaccctaatactgcgcttttccgacaggcttaaaaaacggcgcaccaggagattatatcccgcacctggctcagagggtcctacgcccacggagtcttgctgattgctagcacagcagtctgagatcaaactgcaaggcggcagccaggctgggggaggggcgcctgccattgcccaggcttgcttaggtaaacaaagcagccaggaggctcgaactgggtggagcccaccacagctcaaggaggcctgcctgcctctgtaggctccacctctgggggcagggcacagacaaacaaaaagacagcagtaacctctgcagtgttaaatatccctgtctgacagctttgaagagagcagtggttctcccagcacacctctggagatctgagaatgggcagactgcctcctcaagtgggtccctgacccctgacccccgagcagcctacctgggaggcaccccccagtaggggcagattgacagcccacacggccgggtactcctctgagacaaaacttccagagaaatgatcagacagcagcattcgtggttcacgaaaatctgctgttctgcagccaccactgctgatacccaggcaaacagggtctggagtggaccgctagcaaactccaacagacctgcagctgagggtcctgtctgttagaaggaaaactaacaaacagaaagacatccgcaccaaaaacccatctgtacatcaccatcatcagagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgagttgagagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactatgtgaagaatgcagaagcctcaggagccgatgcgatcagctggaagaaagggtatcagtgatggaagatgaaatgaatgaaatgaagtgagaagggaagtttagagaaaaaagaataaaaagaaacaagcaaagcctccaggaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcactaaacatggaaaggaacaacctgtaccagccactgcaaaatcatgccaaattgtaaagaccatcgaggctaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagactcatcagtgtgctgtattcaggaaacccatctcatgtgcagagacacacataggctcaaaataaaaggatggaggaagatctaccaaacaaatggaaaacaaaaaaaggcaggggttgcaatcctagtctctgataaaacagactttaaaccaacaaagatcaaaagagacaaagaaggccattacataatggtaaagggatcagttcaacaagaagagctaactgtcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatacccagaaattgaactcagctctgcaccaagcggacctaatagacatctacagaactctccaccccaaatcaacagaatatacatttttttcagcaccacaccacacctattccaaaattgaccacatacttggaagtaaagctctcctcagcaaacgtaaaagaacagaaattataacaaactgtctctcagaccacagtgcaatcaaactagaactcaggattaagaaactcactcaaaaccactcagctgcatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagaagaactgaaggaaatacagacacaaaaaaacccttcaaaaaattaatgaattcaggagctggttttttgaaaggatcaacaaaattgatagaccactagcaagactaataaagaagaaaagagagaagaatcaaatagacgcaataaaaaatgataaaggggatatcaccaccgagcccacagaaatacaaactaccatcagagaatactgcaaacacctctacgcaaataaactagaaaatctagaagaaatggataaattcctcgacacatacaccctcccaagactaaaccaggaagaagttgaatctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcagcatcctgataccaaagccgggcagagacagaaacaaaaaagagaattttagaccaatatccttgatgagcattgatgcaaaaaccctcaataaaatactggcaaaccaaatccagcagcacatccaaaagcttatccaccatgatcaagtgggcctcatccctgagatgcaaggctggttcaatatatgcaaatcaataaatgtaatccaacatataaacagaaccaaagacaaaaaccacatgattatctcaatagatgcagaaaaggcctttgacaaaattcaacaatgcttcatgctaaaaactctcaataaattaggtattgatgggacatatctcaaaataataagagctatctatgacaaacccacagccaatatcatactgaatgggcaaaaactagaagcattccccttgaaaactggcacaagacagggatgccctctctcaccactcctattcaacgtagtgttggaagttctggccagggcaattaggcaggagaaggaaataaagggtactcagttaggaaaagaggaagtcaaattgtccctgtttgcagatgacatgattgtatatctagaaaaccccattttctcagcacaaaatctcctaaagctgataagcaacttcagcaaagtctcaggatacaaaatcaatgtacaaaaatcacaagcattcttatacaccaagaagagacagagagccaaatcatgagtgaactcccattcacaattgcttcaaagagaataaaatacttaggaatccaacttacaagggacatgaaggacctcttcaaggagaactacaaaccactgctcaatgaaataaaagaggttacaaacaaatggaagaacattccatgctcatggataggaggaatcaatatcacgaaaatggccatactgcccaaggtaatttatagattcaatgccatccccatcaagctaccaatgactttcttcacagaattggaaaatactactttaaagttcatatggaaccaaaaaagagcccgcatcgccaagtcaatcctaagccaaaagaacaaagctggaggcatcatgctacctgacttcaaactatactacaaggctacagtaatcaaaacagcatggtactggtaccaaaacagagatatagatcaatggaacagaacagagccctcagaaataatgctgcatatctacaactatctgatctttgacaaacctgagaaaaacaagaaatggggaaaggattccctatttaataaatggtgctgggaaaactggctagccatgtgtagaaagctgaaactggatcccttccttacaccttatacaaaaatcaattcaagatggattaaagacttaaatgttagacctaaaaccataaaaaccctagaggaaaacctaggcattaccattcaggacagaggcatgggcaaggacttcatgtctaaaacaccaaaagcaatggcaacagaagccaaaattgacaaatgggatctaattaaactaaagagcttctgcacagcaaacgaaactaccatcagagcgaacaggtaacctacaaaatgggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactaggtatatacccaaaggactataaatcatgctgctataaagacacatgcagacatatgtttattgcggcactattcacaatagcaaagacttggaaccaacccaaatgtctacaatgatagactagattaagaaaatgtggcacatatacaccatggaatactatgcagccataaaaaaggatgatttcatgtcctttgtagggacatggatgaaattggaaatcatcattctctgtaaactatcgcaaggacaaaaaaccaaacaccacatgttctcactcataggtgggaattgaacaatgagaacacatggacacaggaaggggaacatcacactctggggactgttgtggggtggggggagaggggagggatagcattaggagatatacctgatgctaaatgacgagttaatgagtgcagcacaccagcatggcacatgtatacatatgtaactaacctgcacattgtgcacatgtaccctaaaacttaaagtataaaaaaaaaaatctggcaaattttttgccagaactgcaatttactcgaacattttccttgccttagta

SEQ ID NO: 545 - DNA, 12951 bp, Homo sapiens
aacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaagacatgctgggtttctagcactgaaatctcaagtctagacccaagatagctgtgcagtcacccaggccaggaaatccctgtgaaggcagacctcacttgttgcaggttgggtccctcagaaagcagagtctgagatgtcaactaagatatatgaggtttatgggagtcgggggagttgctcttggaatccacaactgcagaaaggaaagggagtagacaggattggacagagggagaaggtgagcagcaatgcaatttctggagcctaagctattcctacagaaagctccgaagctgagatgacctttagagttttacccagttggtctaaggggctgggcctttataccccatgtcaatcagtcatcacatgtgggccaccccaggatggggtgaggcagctctttatagctaaagcagtctccaaagtgggctgtcagctgagggctctctgccaacagcactcccatcagttgggagaataagttcttcattcccgaggtgaatctggatggcacaccatagcatccgccacaccactgcacctatttacagaagggtctggcagcccagcagcaggggtgggtgcatcttgtaaggaactgtgaagggtctgagatttacctgacttgcaagctaacaagtgagcctgccaccattttgtagcggcaggcagaagacacgggactcctggatcagagacaaagggctttattatgatgaaccatgatgaactcatggttcatcaggaagcatgagcttcatgcttgcctcattttcccttggcccccaaattccacagggtgatgcaaagtgggcccaggtggatactggcacataatagtctgtgatacaactaaatgatcccgagcatagaaaactcccaaccttgtaaagaaactgcgagcaaacctgtctaaactttgccaccaaaggagacattatcctttttattcttgtcagcaaacagataaacattctctccagtgtctctgccctggagagagacactatctttatgtctctatactttacaaacatccttgaaaagatggtctgaaacgaaagctgtcataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtggttcaacatgagaactctggtcatcttccctgcaattccttaggtcagcagtggacaatgggaacataatgtgagccacatatgtcatttaaaatattcggttgcctcattttttaaagtaaaagtaaaaataaaaataaatgattaaaattaattttaatacattttatttaatccactatatctgaaatattgtcatgtcaacgtgataaatttgaagttactaatgtggggccggatgcagtggctcacacctgtaatcccagcactttgggaagccaaggtgggcagattgcttgagcccaggagttcgagaccagcctgggcagcatggcaaaaaccgtgtctctacaaaaaattaaaaaattagctgggtgggtatgtgcctgtaatcccagctactcgggaggctgaggtgggaggattacttgagcccagaaggtggaggttgcagtaagccaagatcacaccactgcactccagcctgggcgacagagaccctgtctcaaaaaaaaaaaaaaaaagttactaatatgatattttacatttccttttttgcatgaagcttttgaaatttggtgtgcatttaacacttatagttctgggcatgcttcaagtatgcaaaggtatacatggcttgcagctactgtattggatagtgcagctctggatgtgctccacatggtgacaggacagctatagctgccccaaacatcatgtcttcacagctgtattcgaaggcagggatcagaaggtgacattgggcagagagtctctcctcacacacctcttgctcatcagggagaaaaatactggcctatccctcccctatcccacacacgcccaacaggctaccacttggtcatatggtcaattctggttgtaggaaagtctagggtagggtctggctctttcattctatctagaaggaggccagcaaggaggaagataactggggaaagttttagggcagcacagcagcgtctgcctcatctagagtacggagtggccaatcctctgagctgtatgtgcctcatcactctccctggcctgcccatggccgaaatcactgacaactcatggaaccctttaccattggatccaaatgtaacctcaaaagcccacccaacagcaggttgcaagcagtgacagtctatatgattgtcagcgtatgtgacttatatgcagactgaatttgtggactagagttaaacttcttgagagcagggccacatccttcattctctctgtggcacctacagcactgcttgtgctcaaggggaaactcaaagcagtaagaatgttttctcccttagctcagctgaacgttgcagtttctccatgaggagaaatcaaagccccttagctttgttctctgactccttaatgtccaatacaggctaggacaaccttaggcccctcgcctgtgggcctctttataaagggtcacctgttatcttttgctttattttactcatggggtctattcccaagtacttcacaaacacataattcacagggtagaaccagaacatcagctgtgtcaccctcatttggaagagcaaaggaatttatctccctaagcccttctaggcagcacagacttatcgtggactcagaagccagcaggctccttctctctggctctgacaccctgtgtaactgtccctgagccttctcagacagagctgctccagctgcaccaagagtaggccccagttgcataatcagttgttaaaatacttggcttccagctgggcgtggtgactcactcctgtaatcccagcactttcggaggccgaggcggatggatcacatgaggtcaggagttagagaccagcctggccaacatggtgaaaccccatctctactaaaaaagaaaaaaacacaaaaattagctgggtgtggtggtgcacacctgtagtcccagctacttgagaggttcaggcacgagaatcacttgaaaccaggaggtggaagcttcagttaatcaagattgcaccactgcacctccagcctgggtaacagagtgagaccctgtctcaaaaaataaaaaaacaaaacttaactttggagcaaattaaaccaaattaagaaggaatggggttggcatgagctcctacttgtgtttacttgcgagtcgcaggaaaatccgggtccttggtcttgttgtttgtctgtaagacagcgtgtgcttgcctgaagtgcatctgcatttctcaggtaagatggacagccacagggaaaactgcttagggggataaaagaagagtaagaatgtggggttgtgtttctttttggtcttttttctctgttgggctttttgtttatttattttggcttataatgcagcacattgtatatataattttgtagcttctttaaaatttctacattacaaaataaatatttcattcttaaaaatgtatgtgcataccatttttaatgactgtataatattctatctgggtagaccaggcacggtggctcatacctataatcccagcactttgggaggctgaggcgggaggatcacttgaggccaggagctggagaccagcctgggcaaacatgagacctcatctctttaaaaaaaaaaaaaaaaaaaaaaagctggcagccaagatggccaaataggaacagctcgggtctacagctcccagcatgagcaacgcagaagacgggtgatttctgcattttccatctgaggtactgggttcatctcactagggagtgccagacagtgggcacaggacagtgggtgcagtgcaccgtgcgcaagccgaagcagggcgaggcattgcctcactcgagaagtgcaaggggtcagggagttccctttcctagtcaaagaaaggggtgacagatggcacctggaaaatcgggtcactctcaccctaatactgcgcttttccgacaggcttaaaaaacggcgcaccaggagattatatcccgcacctggctcagagggtcctacgcccacggagtcttgctgattgctagcacagcagtctgagatcaaactgcaaggcggcagccaggctgggggaggggcgcctgccattgcccaggcttgcttaggtaaacaaagcagccaggaggctcgaactgggtggagcccaccacagctcaaggaggcctgcctgcctctgtaggctccacctctgggggcagggcacagacaaacaaaaagacagcagtaacctctgcagtgttaaatatccctgtctgacagctttgaagagagcagtggttctcccagcacacctctggagatctgagaatgggcagactgcctcctcaagtgggtccctgacccctgacccccgagcagcctacctgggaggcaccccccagtaggggcagattgacagcccacacggccgggtactcctctgagacaaaacttccagagaaatgatcagacagcagcattcgtggttcacgaaaatctgctgttctgcagccaccactgctgatacccaggcaaacagggtctggagtggaccgctagcaaactccaacagacctgcagctgagggtcctgtctgttagaaggaaaactaacaaacagaaagacatccgcaccaaaaacccatctgtacatcaccatcatcagagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgagttgagagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactatgtgaagaatgcagaagcctcaggagccgatgcgatcagctggaagaaagggtatcagtgatggaagatgaaatgaatgaaatgaagtgagaagggaagtttagagaaaaaagaataaaaagaaacaagcaaagcctccaggaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcactaaacatggaaaggaacaacctgtaccagccactgcaaaatcatgccaaattgtaaagaccatcgaggctaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagactcatcagtgtgctgtattcaggaaacccatctcatgtgcagagacacacataggctcaaaataaaaggatggaggaagatctaccaaacaaatggaaaacaaaaaaaggcaggggttgcaatcctagtctctgataaaacagactttaaaccaacaaagatcaaaagagacaaagaaggccattacataatggtaaagggatcagttcaacaagaagagctaactgtcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatacccagaaattgaactcagctctgcaccaagcggacctaatagacatctacagaactctccaccccaaatcaacagaatatacatttttttcagcaccacaccacacctattccaaaattgaccacatacttggaagtaaagctctcctcagcaaacgtaaaagaacagaaattataacaaactgtctctcagaccacagtgcaatcaaactagaactcaggattaagaaactcactcaaaaccactcagctgcatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagaagaactgaaggaaatacagacacaaaaaaacccttcaaaaaattaatgaattcaggagctggttttttgaaaggatcaacaaaattgatagaccactagcaagactaataaagaagaaaagagagaagaatcaaatagacgcaataaaaaatgataaaggggatatcaccaccgagcccacagaaatacaaactaccatcagagaatactgcaaacacctctacgcaaataaactagaaaatctagaagaaatggataaattcctcgacacatacaccctcccaagactaaaccaggaagaagttgaatctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcagcatcctgataccaaagccgggcagagacagaaacaaaaaagagaattttagaccaatatccttgatgagcattgatgcaaaaaccctcaataaaatactggcaaaccaaatccagcagcacatccaaaagcttatccaccatgatcaagtgggcctcatccctgagatgcaaggctggttcaatatatgcaaatcaataaatgtaatccaacatataaacagaaccaaagacaaaaaccacatgattatctcaatagatgcagaaaaggcctttgacaaaattcaacaatgcttcatgctaaaaactctcaataaattaggtattgatgggacatatctcaaaataataagagctatctatgacaaacccacagccaatatcatactgaatgggcaaaaactagaagcattccccttgaaaactggcacaagacagggatgccctctctcaccactcctattcaacgtagtgttggaagttctggccagggcaattaggcaggagaaggaaataaagggtactcagttaggaaaagaggaagtcaaattgtccctgtttgcagatgacatgattgtatatctagaaaaccccattttctcagcacaaaatctcctaaagctgataagcaacttcagcaaagtctcaggatacaaaatcaatgtacaaaaatcacaagcattcttatacaccaagaagagacagagagccaaatcatgagtgaactcccattcacaattgcttcaaagagaataaaatacttaggaatccaacttacaagggacatgaaggacctcttcaaggagaactacaaaccactgctcaatgaaataaaagaggttacaaacaaatggaagaacattccatgctcatggataggaggaatcaatatcacgaaaatggccatactgcccaaggtaatttatagattcaatgccatccccatcaagctaccaatgactttcttcacagaattggaaaatactactttaaagttcatatggaaccaaaaaagagcccgcatcgccaagtcaatcctaagccaaaagaacaaagctggaggcatcatgctacctgacttcaaactatactacaaggctacagtaatcaaaacagcatggtactggtaccaaaacagagatatagatcaatggaacagaacagagccctcagaaataatgctgcatatctacaactatctgatctttgacaaacctgagaaaaacaagaaatggggaaaggattccctatttaataaatggtgctgggaaaactggctagccatgtgtagaaagctgaaactggatcccttccttacaccttatacaaaaatcaattcaagatggattaaagacttaaatgttagacctaaaaccataaaaaccctagaggaaaacctaggcattaccattcaggacagaggcatgggcaaggacttcatgtctaaaacaccaaaagcaatggcaacagaagccaaaattgacaaatgggatctaattaaactaaagagcttctgcacagcaaacgaaactaccatcagagcgaacaggtaacctacaaaatgggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactaggtatatacccaaaggactataaatcatgctgctataaagacacatgcagacatatgtttattgcggcactattcacaatagcaaagacttggaaccaacccaaatgtctacaatgatagactagattaagaaaatgtggcacatatacaccatggaatactatgcagccataaaaaaggatgatttcatgtcctttgtagggacatggatgaaattggaaatcatcattctctgtaaactatcgcaaggacaaaaaaccaaacaccacatgttctcactcataggtgggaattgaacaatgagaacacatggacacaggaaggggaacatcacactctggggactgttgtggggtggggggagaggggagggatagcattaggagatatacctgatgctaaatgacgagttaatgagtgcagcacaccagcatggcacatgtatacatatgtaactaacctgcacattgtgcacatgtaccctaaaacttaaagtataaaaaaaaaaatctggcaaattttttgccagaactgcaatttactcgaacattttccttgccttagtacagttgcttttagtttttcaattataattaagtcttcttagataaaggatttaaaaaaaaaaaaaaccctttcctattctacatgagaatttgacctttggttaactttctagctctgttttccttgagatctcataaaagtggactatcaacggttttactaggcaacattgcttatgtaaaaatggcctttgcttgggaaactgcatctgaactgagaaaaccataactacctggtgagaagtcttcctcagggcctccttgagtgcagtgactcctcctggtcctgcctcctacctactaagttgttacaggagatacttttgtagggcatatgaggttttgaagccagggtcattcttttgtctgtatgatgtggatctcaactctttttttttttttttcttttttttgagacagagtcttgctctgtcacccaggctggagtgcagtggtgcaatcttggctcactgcaacccccggctcccaggttcaagtgattctcctacctcagcctctcgagtagttgggattacaggcacctgccaccacacccagctaatttttgtatttttagtagagacggggtttcaccaggttggtcaggctggtctcaaactcctggcctcaggtgatccacccgccttggcctcccaaagtgctgggattgcaggcatgagctaccatgcccggccagatctcaactgtttgtgcctgggctgtaacctggttgggaggcaaagagaccctctcctggacagctgtgtgaactgctgtatggactgctacatggtcttccattgagaggagcacctcctgccactgtgtttctccaggctgtcttcccttggctcatggtggtcttataagtctgaatgtttagtggtatcaaagaagacccttggtggacttggcatcctacatttaggattatttccttaggagagcttcaccaaagtagaataactgggtcccatactatgggctccttaatacagatataaagtcaagtctatttcccaaagagttgtatcaccagctttcaccagctgtgcaatgaggcagccatttctaggtactctcaccagaatttttttgaaattttgtagatttgatcataaaaattggtttcttgtcataatttacagttttaaaaaatcttaaactgtaggtttgagaactgctagcatttcctcttttgtgaattgatgctttctttcgcccagaaaaaaagttaaattgcaagtaaacgggatttaaaaattttaaattgcaaagtgcaaccagatgtaagaggcattttccccctctgttctaaactgctttttctgcccttctaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccacaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttat

SEQ ID NO: 546 - DNA, 1651 bp, Homo sapiens
cagcactcacgtttccgcaaagacgtagagtgcggtgatgcacttgggaggctggggtgggtccaggtggtcgaggcatgccacagtgttgacaacaccaaagaggacggccgccttcacccagtcatacaccaggtttgaataggctaggccagctgggggcagggcactgtcactgcctggggtccaatcgcctggggcctgcccccatgaagaccctgtcccaccacttccttggggagacaccaggctctgcccgccccacggagacccccccatattgtggaaatcagtcatgcctggtgaagtgggtggggtccgtgggatgctgctctggccccacaggatgaagctaatgccaagacccatgcattagaaagaataagcccctgctcccacgccctcaggtgctgtgccctgcgtgcctcagctcccctgactgtggcaccgtgggggtgcagagggtctgttttcctggggcggcagccctgcccccatttctcttctgtggacccaccgagggcactgtctgggaggcggttggcgaacttgaggtcgctggggatagtgaggatgtagaagaagtgaaagaagatgtcgacggccatgatggccaccacgcttaggcctgcctgggctcggatgtgccacagctcaccctcgcgtctcactggctccacctggctcacctggggggatgcgaagggtctgagggaagaggcaagccctgcctggggagccctgtctgaggggggctcaccaactacttggggcaggaggagccatggctttatccaggagtcctgcctgagggtggagacagaggtcaccctggagtctgaggaggattcacagccagccatgggagacccagttctgtcctgggagccccatttgagtgggaagggaacattcgtggcctgggagtcctgtctgagaaaagagacatgtctccaccctggggtccctgctggaggggaaaggtggccccatcctggggtctgaggagggaggggagacacggcttcatcctggaatcatgcctgaggatggggatacagcctgcttggggaattctatctgagatggaaaccccaatctgaaaagggagattcagccctgttctagaagcccacagggtgtcccctcacctgagcatggaagcgatcaaaggtcatgatgggcccgaagaagaagaagggcaggtagaagttgtacttgagcaggtcagctaaggagtagtggcggtcagggtgggcacagctctccagtgcaaagctggtgcaacgcagcactgtgaagctgctgcccccatgaaacagcacctcttgaagatcaaaagtgcctgttacaaacccgctctggagggggaaagaacaggccaccagctcactagggtgcctcctgtctctggaaaacctattccccactccctagcttcccacaggggcccagcctggtcctgtcccttcctctcttccagagccagttaactttggccactgctctatcccagcaatgcgaggagcaggggatgatctggatagttcctcctgtgatgcaggtgctcaccttgtggccaggacatacccaaaggcttgaagacaggtggaaagtgaagggaatacttggggatacttggggtgcaagg

SEQ ID NO: 547 - DNA, 4799 bp, Homo sapiens
cagcactcacgtttccgcaaagacgtagagtgcggtgatgcacttgggaggctggggtgggtccaggtggtcgaggcatgccacagtgttgacaacaccaaagaggacggccgccttcacccagtcatacaccaggtttgaataggctaggccagctgggggcagggcactgtcactgcctggggtccaatcgcctggggcctgcccccatgaagaccctgtcccaccacttccttggggagacaccaggctctgcccgccccacggagacccccccatattgtggaaatcagtcatgcctggtgaagtgggtggggtccgtgggatgctgctctggccccacaggatgaagctaatgccaagacccatgcattagaaagaataagcccctgctcccacgccctcaggtgctgtgccctgcgtgcctcagctcccctgactgtggcaccgtgggggtgcagagggtctgttttcctggggcggcagccctgcccccatttctcttctgtggacccaccgagggcactgtctgggaggcggttggcgaacttgaggtcgctggggatagtgaggatgtagaagaagtgaaagaagatgtcgacggccatgatggccaccacgcttaggcctgcctgggctcggatgtgccacagctcaccctcgcgtctcactggctccacctggctcacctggggggatgcgaagggtctgagggaagaggcaagccctgcctggggagccctgtctgaggggggctcaccaactacttggggcaggaggagccatggctttatccaggagtcctgcctgagggtggagacagaggtcaccctggagtctgaggaggattcacagccagccatgggagacccagttctgtcctgggagccccatttgagtgggaagggaacattcgtggcctgggagtcctgtctgagaaaagagacatgtctccaccctggggtccctgctggaggggaaaggtggccccatcctggggtctgaggagggaggggagacacggcttcatcctggaatcatgcctgaggatggggatacagcctgcttggggaattctatctgagatggaaaccccaatctgaaaagggagattcagccctgttctagaagcccacagggtgtcccctcacctgagcatggaagcgatcaaaggtcatgatgggcccgaagaagaagaagggcaggtagaagttgtacttgagcaggtcagctaaggagtagtggcggtcagggtgggcacagctctccagtgcaaagctggtgcaacgcagcactgtgaagctgctgcccccatgaaacagcacctcttgaagatcaaaagtgcctgttacaaacccgctctggagggggaaagaacaggccaccagctcactagggtgcctcctgtctctggaaaacctattccccactccctagcttcccacaggggcccagcctggtcctgtcccttcctctcttccagagccagttaactttggccactgctctatcccagcaatgcgaggagcaggggatgatctggatagttcctcctgtgatgcaggtgctcaccttgtggccaggacatacccaaaggcttgaagacaggtggaaagtgaagggaatacttggggatacttggggtgcaaggactttggatgaagtgagaggtttgggatcttatccctacaccctctacccctgcaccagttcacacctgccaagagattagggggtccatcttgaaggaggccaggctggccaagccaaggccaagacagagccagggctggcccaaaagcgaggccacatagaggcccacacagtgaccaagcagcagcagcaggtaccaagggcccattgtgcccatcacagccaaggccccgtacacagcatacatccaggagcggagctgtgggcagggagaaggcttcagtttcgccatataaatgggggcgtgaccccaggagggggttcccacaacccttgtggtgaaagaggagctggcagggagaggctgggtggcccaggtccagctcacctttggggcaaccatcgtgcagagtttagcaaacagcacatgtccggagagggcaaagatgatgacgttgcgaaaggaggtgaaccacatcacccactcgaagtcagccacatcctggggcagtccggggcagaaggaggtggggcaggtgagggtgggagaggggacaggacgagctggaacctgggctggtcagagccccagcacctttcccagccttcatgttcttcttttattattatcatttttaaatttaataataataattattttttaccactagccaaacccaacgtgtcctctttatgcaaacacaagagcagtgcctgcaggtctccacactcctctgtgaaggaagtaccgaggcaggagggtagagaggagtgaagggcaccatgggggctgccgggtcgcttgaagctccccctctcctccgcacgttgcctgccattccccctttactgctttgtttctgggaaggaggtgctggaggctccactgaagcacactccactaatgcgacctatttcccaagtgagcagggcccgggcaaacttgatgtcccaggaggatacaggaggggccagtaaagaagctgaaggcactgaagctcaagccagaggccccagagctgtgagaagctctctgttacttgccaacatctggaacagcagagagcagagaagggttcgggatgggagggaccctgggatgtgggggacctaccatcttccggccaatgtactcccagccaggtcgcacagactcccggaaggccttcctgtgggccccatctgagaacagagtgtggcctcagggagaggggccttcacatcccctgccccaccttcccccgtggacaaggctgccccaccctggggagcgagggcatcaggaacggggcacgggtctgagtctctttggtgctgcatctgcttctttctgggtctcgctgtgtgtctgggtccaggactctgtgtgtgtgtgtgtgtgttggggtgtgtgtgtatatgtctgtgtgtttgtgtgtgtgtcggggtccaggtctctgtgtgtgtgtgtgtgtgtcgggatgtgtgtgtgtgtatgtctgggtctaggtctctgtgtgtgtgtgtctgggtccaggactctgtgtgtgtgtgtgtgtgtgtgtgtgttggggtgtgtgtgtatatgtctgtgtgtttgtgtgtgtgtctgcatccaggtctctctctgtgtgtgtgtgtctgggtccaggtctctgtgtgtgtatgtgtgtgtgtgtgtgttggggggtgtgtgtatatgtctgtgtgtttgtgtgtgtgtctgggtctaggtctctgtgtgtgtgtgtgtgtgtcgggatgtgtgtgtgtgtatgtctgggtctaggtctctgtgtgtgtgtgtctgggtccaggcctctgtgtgtgtgtgtgtgtgtgtctatgtgtgtgactctgtgtccatctctctgtcagtgtctctgcatctctgtgttcctgtgactgaacctggctccacccagcctccagtgactatctgagatgggaaccccgggctgaaaagggagatccagccgtgttctagaaggagtaccctaggtctggagcctgtaactttctggctttgctggttggaaccctgaggcctccaggggaagaagggtcctgtccacctgccccggggcacagccattaccttgtgaagcctcaaggaggccccggccagcataggccagggccccactcagcaccagagagtagaggcccagctcagccgccggcaatgctgtcttgatgcccatagcctggacagggctggggagacaggttgggtgagggaattacagtctccagccaagcctagccccacctcatggtcccaccaccccagtggggacccactctgaagagagattgcccctccagccccttggggaccttgtaccatcactctgcctgcccctgtgccccccacagttcacaggccaccgaacaccagtgccccatcccagctgctgctcttgcccccaccccacccatcaaggctcttgcccgcagagccctcactcgcagcctgcctccctcaccttcatttacatcttcataccttccagaggcaccggccccaccctctgccaaaaccgctcctgccaaggcccccatgacctgcgtgcggagaaaccccacctctatcactacagtcaggtttctgcctgcagggtccccacctcgatcagtgagtctcccttagctcctcacaaagccccagcttctctaagaccctttctctgactcccactcccctccctgagatcccatgaccaccccaggtgctgcccctagagccaagcctccatcctcgcattaagcctccagcctgtcactgacccccattcccccaacaagtccctgagctccagcctgtcacatcccagtccctgcctgtgtccgtgaccacactgccccactctctcagcgctctgtgtattcaggccctgggcaccagctggaggctgtgctatttgaggaggtgcccaggagtagcggatgtggggccaggcggggccaggcggggccagggagggcactggctgctgtccaaggtgctgaccagaatcaggccccggctgagtctcaccactccctccagcgggggcctagcttgtcccctggagaactgctgggccgtactacggctcagctagcacctttacccttcctatcccgcttcagcctggctcaggggcttcccaaggactccatgg

SEQ ID NO: 548 - DNA, 10253 bp, Homo sapiens
gacgtgagacttagtagaaatggagcatggaaattctcaaggagaggacattgatggggtggtgtgggcagtgtagaccttcctggaggggaactttgaggaatatgggaacaccccttgagaggtgatctttcctggggagaaagacccttcctggagtgtggggtgggtgttccttggggtgggtcttgtggggggtctcctttcccagagcctggggattttcaggagcagatctccctagagatgggccaagtgccctcagccacccctctctgctgcgttccactctggactcagctgaccaagctctccatccttgtccccactctctctcatccccaggtataacgaggaggagaagaaatgggagggtgtcctgcgggagatcgcctatgcagcaggtgccaccttcctaccagtgcggctcaatgtgctgtgcctgactaagatgtgaccagctcaggcagactgaactaagcacccctcccatcctgcgaccctcactggcctggccttgtgggggctccagaaaagaggctaggagaggccagagtctacctggatccagttatggtgcctcaggggctgcgtcagccaaggaaagggaagtgctgcttagtcctggacttttgggcaagggtgagaaactagaggcttctccagtgttgccatatccccctaggttgtcttgatccatgaaccagaaccacagggcggtatcccaggccgtgtgctggccctgccccagcctagctgagtgtgctggcaaagttccccacaggactcagccttctcgtctttccgatgggagcatccccatcaagtgcagtgtacagtgcagatatgtctccttctttaggaagaataaagtgccttctgagcaagcagctcagggtctgcatcagtgctccaagagtcagtgagcaggtgtgttgaagacttggggcttcagtgttctgctgttgggctgccaaggtcgatggtctctgctctccatctggtgtcccctccaccctatgggtgggaaccctcccctgcctgaggcctagagcctccagctcctcagccactatggacgtggagccaggggactgtgggaagaagggtcagggaacagccaagctgttgtagaaaagtcttttattctatcggtcaggccccatctggcccaagaatagctgagcagagcccatccctctacccgctccctcctactccggcttctctttgtcctgcttctgctcctcctccagtgccaaggttcgctcacgctcctttaccagctggacgccacagtaggtgacaaacaggatggacagcgtggtctgggggaaccctgtgtggggagggagtcatagatgctcaggagcagcactgcatcctcagcgacttttgtcttcccacccctctccccgcttgatgggccctcccttctgagtcccaggggtgatgagggagataggaggcattttggaaggtcacggtccttgaggctgatgcctggcaccttctgtatccccacacccctgtccctcacctgtgagtagcaggcgccgggcaaccagctctgtgaatttgaggctgttcaggctcacaaggttgtacatgatgatggcccagaagttcatggctccaaacagggcccggaccctacgggacatctgcactgacagagaggcctatccggtccaggaaagcatgggcagcgggacaagaggccaaaggaaagaggacatggtgggtcagcagccttacccacctggccagtcaggtcttggggctatgtctgggtctcggagagccccaggtcagctctccctccttgttaaacatggggaaacaggtccagagagaggacaaggcctgaccaacatggcaaggcccaggtgctccattcctcatagaagggagggaggggcagattcctacagagtgagccattgctctgacaactaagagggtggtggtgagaaagttctggattaggggccaggtgtttggacaactccagaaagcagcagtgcccccccgccctctatgacccagccagtcccagccccaggtcttccctgctcacctcaattcgtgctaggggcccccactctgccagtttttgcatccagagctcaaagttgaggccaaagcagttaaggaatgaccacaggtagacaatgtcacaaggcccaagccacagtgtggtgatggcaaatgtggccactgtggctgccagctctgggatcacagcggaatgctccccaccaatgtggttatacacatatctgcaggaaagatgggagaagggccactgggagtgtgggaaagggcagggatgagatgggagaggacacacaacagggcgtcctcctcaacactgtcaccctgggtgcattcaacattcctgacctcacgtagcagctcctcctccaaccaacttcaaattgtggcaggctcagcctgggacattatagcttctctatctctgttcgtttacttcccaaatgatctcatccagacccaagatttcaagtactagctctatgacgatgacccctaaatctgtgtctttagcccagtctctcctgatttgtatatgcaattgctactagccatgtcacttgattgacagattcccctatccctgctcaaacccagctccgtcctcatctcagtgaatggcaccaccatccattcagttgctcagggtataagccttggtgccatcttggattctcagtttgcctcatcacccacatccaagcaagccagcaaattctgttggctcctctcagtcctgaccaccactcacctcctctaccaccaccaccctagtcaagatgatcactcttctcacataaattattgcaagagcctcttaagtggtcttcttgtttctgcttttgcccccatggttcattctccacacagcagccagaggcatcttttaagagtgtagctcaggtcacatcacttccatgattaacctctctgaatagctccccattacaataggaataaactcagtctctttactctggctagaagatcccaagtggtctggtttctgttcccttcctgaccaaatcagccaccatgctcccccagttcatcatgctggcctcactggcctttcttacctttacacccacacagttggtttgtgtctcaaggcctttgcccttgttgttccctctacctggtattctctgctccacatctccttatcactcaaatctcaattcaaatatcatctcctcagagaagcctgcctagaccccgactaaagaagcttctaccctgttgtcaacttctatcccattgcaattttattttcttcataacacttaccactctctaaaattatcttatttatgtttgtttacctgtttatggtctgtttctccccactagactgtaagctccatgagttcagggtctttgccatgttcactgctgtatccccagtgcctagaacaatgcctggcacataggtgctcaataaatatttgttaaataagttctgtggaagacccaggaataaccagcctctccattcctcgacctcctcatttccaatggctttttctccactccacctcagccacccacacccatggccatgccccaactttgtcaccacttgaaagttcactcctttctaattcccattctttgcccaactcctcttgacctcctggccccccagcttcagttcttcaatcccattgatcttgtgaccctcccaccttcaccaccgtccttagcaggcttatatccaatgagtcatgactataaataatctaaaaacccttattcctgacttcttccttgtcatccatctgggagagcccaatcacttactttctcctcagctacacccaggcagctaagccccatgggggaaatctcacatcttcacatgctggagttcataagcccaccacctccaataccacctgggtactcagtgccaagatttctctagtcagctgcttctcccttgctctgcaagggccactgtattcttatctccccacaagtatgagtggagagatagtatgagtggggggatccaggctgggttgtgggggtaagcatatatgttgcctctctccacgtccctgtcctggctttctcagctgatggccgtgcctcctgcttcatggacaaggctgaagccttcaggtggaatcccttacttgtctacattaacctgctttcctctgcatccacactggcttctcttcctcctcctcccactgaagccaggcctccgcctggaactagacaccctcacctccttcctcttcagggacctcactccatcaatcacccctgtatcctgcatccccagcttctctgttgaataattcttcttagcatgtcccattctctcctatctttaacacatccctcttctccctcagccactcctgtcttccccctgcagtcccaggcttcttccaggagtcatcacacacttctctactcctcagttgactttccctccttacctgctcctgccttgcccatgaaaggctgaaaacctccatgtcaccagcactaatcctcggtctccagcttccttgaggctcagtggcatctgaccaagctgtccccaccatgcctggatggtcttcccttggcttccagggtggcacatgaccttgattcttctcctgcccctccaactactctttccagtcctttctgctggctccttttccttccaagcagagctcttgcaggctgaatctcggccatccccgtctctcctcttctcacaccactccctctcctgaggacttacccactcccaaagcctaaaaaccacctgcccacactcaggacgctctgagttccatcagtcctctggaccctcagaaacccagaccctcagacccaaccacctccctgaacctccacagggatgtctcctagattgcgactatacatttcttaaactgaagccctctctggaaactgccctccatcctcccaggctgcagacagcaatttgagcgtcatctccttctccttcccaacacccacagttcatggccacgtcctgttcaggctgctgactgtgtgaccctcctcccaccacctctctccacctcgagggccctcacttaaatcctaacttctatatctttcacccagacctctgccaatacctcctcactgccctctttgcttcccctggcccaggggtgatcttttaaaatgtggacccatcttggcactgccctgctcagacacctggcaggatggctgtgaccacccccaccccactcctactcacttgcaaagccagtcgttgatgccacggtcaaagtgcctgtaagaggaaagcagatgggcatgttgccatcaggcgcagagctccccaggcatgggggaagaggctaggggaaggtgtggtcccagggggtgagcctcccccgtcctggccagcactcacgtttccgcaaagacgtagagtgcggtgatgcacttgggaggctggggtgggtccaggtggtcgaggcatgccacagtgttgacaacaccaaagaggacggccgccttcacccagtcatacaccaggtttgaataggctaggccagctgggggcagggcactgtcactgcctggggtccaatcgcctggggcctgcccccatgaagaccctgtcccaccacttccttggggagacaccaggctctgcccgccccacggagacccccccatattgtggaaatcagtcatgcctggtgaagtgggtggggtccgtgggatgctgctctggccccacaggatgaagctaatgccaagacccatgcattagaaagaataagcccctgctcccacgccctcaggtgctgtgccctgcgtgcctcagctcccctgactgtggcaccgtgggggtgcagagggtctgttttcctggggcggcagccctgcccccatttctcttctgtggacccaccgagggcactgtctgggaggcggttggcgaacttgaggtcgctggggatagtgaggatgtagaagaagtgaaagaagatgtcgacggccatgatggccaccacgcttaggcctgcctgggctcggatgtgccacagctcaccctcgcgtctcactggctccacctggctcacctggggggatgcgaagggtctgagggaagaggcaagccctgcctggggagccctgtctgaggggggctcaccaactacttggggcaggaggagccatggctttatccaggagtcctgcctgagggtggagacagaggtcaccctggagtctgaggaggattcacagccagccatgggagacccagttctgtcctgggagccccatttgagtgggaagggaacattcgtggcctgggagtcctgtctgagaaaagagacatgtctccaccctggggtccctgctggaggggaaaggtggccccatcctggggtctgaggagggaggggagacacggcttcatcctggaatcatgcctgaggatggggatacagcctgcttggggaattctatctgagatggaaaccccaatctgaaaagggagattcagccctgttctagaagcccacagggtgtcccctcacctgagcatggaagcgatcaaaggtcatgatgggcccgaagaagaagaagggcaggtagaagttgtacttgagcaggtcagctaaggagtagtggcggtcagggtgggcacagctctccagtgcaaagctggtgcaacgcagcactgtgaagctgctgcccccatgaaacagcacctcttgaagatcaaaagtgcctgttacaaacccgctctggagggggaaagaacaggccaccagctcactagggtgcctcctgtctctggaaaacctattccccactccctagcttcccacaggggcccagcctggtcctgtcccttcctctcttccagagccagttaactttggccactgctctatcccagcaatgcgaggagcaggggatgatctggatagttcctcctgtgatgcaggtgctcaccttgtggccaggacatacccaaaggcttgaagacaggtggaaagtgaagggaatacttggggatacttggggtgcaaggactttggatgaagtgagaggtttgggatcttatccctacaccctctacccctgcaccagttcacacctgccaagagattagggggtccatcttgaaggaggccaggctggccaagccaaggccaagacagagccagggctggcccaaaagcgaggccacatagaggcccacacagtgaccaagcagcagcagcaggtaccaagggcccattgtgcccatcacagccaaggccccgtacacagcatacatccaggagcggagctgtgggcagggagaaggcttcagtttcgccatataaatgggggcgtgaccccaggagggggttcccacaacccttgtggtgaaagaggagctggcagggagaggctgggtggcccaggtccagctcacctttggggcaaccatcgtgcagagtttagcaaacagcacatgtccggagagggcaaagatgatgacgttgcgaaaggaggtgaaccacatcacccactcgaagtcagccacatcctggggcagtccggggcagaaggaggtggggcaggtgagggtgggagaggggacaggacgagctggaacctgggctggtcagagccccagcacctttcccagccttcatgttcttcttttattattatcatttttaaatttaataataataattattttttaccactagccaaacccaacgtgtcctctttatgcaaacacaagagcagtgcctgcaggtctccacactcctctgtgaaggaagtaccgaggcaggagggtagagaggagtgaagggcaccatgggggctgccgggtcgcttgaagctccccctctcctccgcacgttgcctgccattccccctttactgctttgtttctgggaaggaggtgctggaggctccactgaagcacactccactaatgcgacctatttcccaagtgagcagggcccgggcaaacttgatgtcccaggaggatacaggaggggccagtaaagaagctgaaggcactgaagctcaagccagaggccccagagctgtgagaagctctctgttacttgccaacatctggaacagcagagagcagagaagggttcgggatgggagggaccctgggatgtgggggacctaccatcttccggccaatgtactcccagccaggtcgcacagactcccggaaggccttcctgtgggccccatctgagaacagagtgtggcctcagggagaggggccttcacatcccctgccccaccttcccccgtggacaaggctgccccaccctggggagcgagggcatcaggaacggggcacgggtctgagtctctttggtgctgcatctgcttctttctgggtctcgctgtgtgtctgggtccaggactctgtgtgtgtgtgtgtgtgttggggtgtgtgtgtatatgtctgtgtgtttgtgtgtgtgtcggggtccaggtctctgtgtgtgtgtgtgtgtgtcgggatgtgtgtgtgtgtatgtctgggtctaggtctctgtgtgtgtgtgtctgggtccaggactctgtgtgtgtgtgtgtgtgtgtgtgtgttggggtgtgtgtgtatatgtctgtgtgtttgtgtgtgtgtctgcatccaggtctctctctgtgtgtgtgtgtctgggtccaggtctctgtgtgtgtatgtgtgtgtgtgtgtgttggggggtgtgtgtatatgtctgtgtgtttgtgtgtgtgtctgggtctaggtctctgtgtgtgtgtgtgtgtgtcgggatgtgtgtgtgtgtatgtctgggtctaggtctctgtgtgtgtgtgtctgggtccaggcctctgtgtgtgtgtgtgtgtgtgtctatgtgtgtgactctgtgtccatctctctgtcagtgtctctgcatctctgtgttcctgtgactgaacctggctccacccagcctccagtgactatctgagatgggaaccccgggctgaaaagggagatccagccgtgttctagaaggagtaccctaggtctggagcctgtaactttctggctttgctggttggaaccctgaggcctccaggggaagaagggtcctgtccacctgccccggggcacagccattaccttgtgaagcctcaaggaggccccggccagcataggccagggccccactcagcaccagagagtagaggcccagctcagccgccggcaatgctgtcttgatgcccatagcctggacagggctggggagacaggttgggtgagggaattacagtctccagccaagcctagccccacctcatggtcccaccaccccagtggggacccactctgaagagagattgcccctccagccccttggggaccttgtaccatcactctgcctgcccctgtgccccccacagttcacaggccaccgaacaccagtgccccatcccagctgctgctcttgcccccaccccacccatcaaggctcttgcccgcagagccctcactcgcagcctgcctccctcaccttcatttacatcttcataccttccagaggcaccggccccaccctctgccaaaaccgctcctgccaaggcccccatgacctgcgtgcggagaaaccccacctctatcactacagtcaggtttctgcctgcagggtccccacctcgatcagtgagtctcccttagctcctcacaaagccccagcttctctaagaccctttctctgactcccactcccctccctgagatcccatgaccaccccaggtgctgcccctagagccaagcctccatcctcgcattaagcctccagcctgtcactgacccccattcccccaacaagtccctgagctccagcctgtcacatcccagtccctgcctgtgtccgtgaccacactgccccactctctcagcgctctgtgtattcaggccctgggcaccagctggaggctgtgctatttgaggaggtgcccaggagtagcggatgtggggccaggcggggccaggcggggccagggagggcactggctgctgtccaaggtgctgaccagaatcaggccccggctgagtctcaccactccctccagcgggggcctagcttgtcccctggagaactgctgggccgtactacggctcagctagcacctttacccttcctatcccgcttcagcctggctcaggggcttcccaaggactccatgg

SEQ ID NO: 549 - DNA, 11119 bp, Homo sapiens
aggaaaacaacaacagacaaatcctcaacctgttaataagttcaaactgtttgccaattcaactgggaaataatgcattagaaaaaatacctacttgttaacaaagtcattgcatttgtaactaaagagatcacacacaactgtgccatctggtcacaaaacagaagataaggacaagtttctttttataaaagtattccagctaataaatgatgaaggaatgacagactctcttattaaattactggacctaggtgttgaccatcaataacagagacacatcaatcacaagagacaacctgaaacatcatgtgcctcttaatggaagaacacaacaccaactattgaactatctttcaaaaaaaaaaatcaaacttgaatctgattgagcttctaaacaccacagagaagttagaggaacatgtttgtttgttttttgagacggagtctcgctctgtggcccaggctggaatgcagtggggccatcttggctcaccacaatctccgcctcctggattcaagcaattctctggcctcagcctcccaagtagctgggattacaggtgtgcaccatcacgcccagctaatttttatatttttagtagagatggggtttcactgtgttggccgggctggtctcaaactcccgacctcaggtgatctgcccaccttggcttcccaaagtgctgggattacaggcatgagccactacgccccgcctagaggaacatgttaaccaccacaatggtgagccaatcagcaaaatcaaactctggaaaacaccattaagacaaactacctggttttatcaaacaaattggaaagaaaaaaagagcaagaaattgaaaaggacactataggttaaaagagatttaaaatgaaattttaaaaacaatttgaaaaaaatctattcactgtagcatcaagaaagaaagaaagaaagaaaagaaagcaagaaaaaaaaaaggaaaaggaaagaaaaggaaaagaaaagcctgtacactgaaactggaaaatatggcttagttaactaaaaaaatacctaaataaatggagaggcatacgatattcacagactaaaagatccaaagatgccaaaggtaattcaatggaaatggaaaaaggatagtattttcaacaaatggtacagaaacaactggatatccacatggacaaaaatgaacctcaaccttacctcataccatacataaaaactcaaaatggaccataaacctaaatgtaagagccaatattttttaatatccagaaaaagaaaatagaaaatctttctgagcttggactggcaaagaatttttatttttattttgaggcagggtcttgctctgtcgccaagtttggaatgcaatgggcacgatcactgctcactgcagccttgacctcctgggctcaaataatcctcccattctcagcctaccaagtagctaggactacaggcatatgccaccatgccttgctaactttgtttatgttttgtagagaagtggtcgaagtggtctcactatgctgccaggctggtctcaaactcctaaactcaagtgatccttctgcctcagcctcccaaagtgctgggattacaagtgtgagctattgcacccagcctggcaaataactttaaaacatgacaccagaaaaagcacaaacaataaattgggactgtatcaaagtttaaaacgtttgctcttcaggccaggtgccaccccccagctcacgcctataatcttagcactttgggaggctgaggcgggtggatcacctcaggtcaggagttcgagaccagcctggccaacatggtgaaaccccgtctctactaaaaatacaaaaattagccaggacagtggtatgtgcctgtagtcccagttacttaggaggctgaggcagaagaatcacttgaacccgggaggcggaggttgcagtgagccaagatcacaccactacactctagcctgggcaacagggtgagactccatctcaaaaaaaaacaaaacttttgctcttcaaagacacaatgaagaaaaaagacaagccagaggcttaaaaagaaatttttttgcaaaacatatacctaatatggatttatatcaaaaagctcttaaaaataaacaatcctttttttttttttttttttttttgagacagggtctccctctggtcactgggctgcagtgcagtagcaccatcttggctcactgcagcctcaacctcctgggttcaagtgatcctcctgcctcagacctgccaagtagctgggactacaggcgcacgccaccacacccagctaatttttgtatttttttagtagagacagagtttcacctattacccaggctggtctcgagttcctgagctcaagcgatctgcccacctcagcctcccaaatgctaggattataggcatgaggcaccacacccggacaataatccaatttttcaatcaaaagatttgaataggtacttcagcaaagaaaatatatgaatggcaagcacatgaaaagataattagtcactagggaaatacaaattaaaaccactatgaagtatcattacacaccaactaaaatggctaaaatacgaacaataggaaatttaataaggatggagaagtgagtcctcatacaatgctggtgcaaatgtaaaaatggtacagccactttgaaaatggtttggcaatttcttaaaaagctaaacacaggccgggcacggtggctcacgcctgtaatcccagcactttgggaggcagagatgggcagatcatgaggtcaggagattgagaccatcctggctaaaacggtgaaaccccatctctactaaaaatacaaaaaattagccgggcgtagtggcggtcgcctgcagtcccagctactccggaggctgaggcagaagaatagcttgaacctgggaggcggagcctgcagtgagccgagatcgcaccactgcactccagcctgggcgactgagcgagactcagtctcaaaaaaaaacaaaaacaaaaacaaaaaaaaagctaaacatagacttatcatacaaccaagcaattccactcttgaggatcaccaaaaagaaatgaaaacagccacacaaagactttacttgtgttcactgccaagaactagaaataacccaaatgtccatcaactagtgaatggataaacaaaacgttttacctatttatacaatggaattattctcccagcactttgggaggccgaggggggcggatcacgaggtcaggagatcggtaccatcctggctaacactgtgaaacccgtctctactaaaaacacaaaaaattagtctgatgtggtggcaggcacctgtagtcccagctactcgggaggctgaggcaggagaatggcgtgaacccagaaggcggagcttgtagtgagccgagatcatgccactgcactccagcctgggtgacagagcgagagtccatctcaaaaaaaaaaagaaaaggaattattctcagcaataaaaacaaactactgatacatgcaataacaaggataaatctcaaaaacttcatgctatatgaaacatgccagacacaaaagactacatattggatgattctatttatgtgaaatttctagaaaaggcaaaattgtatagaaaatacatcagtggtttcccagaatcaggatgcattgtctgtaaatgaccacattttgggggtaataaaatgttctaaaactaaatggtgatgatggttgcataactctatacaattactaaaattcatcaagtaggtcacttacaatataaaacatgcttcaataaaacattgtttaaaaaaagagagaagataacacaacgtgttggtcaattggatcctttaaacaatattttttaaatttatttttgttattgtaaaatacacataaaatttaccattctaatcaccttagatgtatagttctgtggcattaaggacattcacaatgttgtacaagaaaattttttaaattacagcatgtataacaatgggaactgagctctgcataaattctagtgttcataagaaaaaatgtagatcaggtcgggcacggtggctcacgcctgtaatcccagcactttgggaggccaagacgggcagatcacgaggccaacacggagaaaccccgtctctactaaaaatacaaaaaatttgccgggcgtggtggcgggcgcctgtagtcccagctactccggaggctgaggcaggagaatggcatgaacccaggaggtgaagcttgcggtgagccgagatcgcgccactgcactctagcctgggtgacagagagagactccgtctcaaaaaaaagaaaagaaaagaaaaaatgtagatcaataatattattttgctgacgcattggagaaagtaaaggctgggtgcagcttcaagctgaggaccacccaccatgcccccatcatggtggttcccctaggtgctgaagggcccagccatagctctcgccctcgcagggtccctccagggtctctgctgtttcctacctaggggtgactgcagccatggctaagaaagcgccagcgcccacccacctgggccaatggactggttctgctcgtgccacgctggttctgctcctcgccatctcggcagttcagaaagaaccccaacgagcttgtgatctcccgggtcctgtgggcgtatcaacagggggccagccctgtccctcaaccctggggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcctctgaccaggcctgcggggaggagccacccacgcgccacagcaagtcctggacctggccctgcattccagggtggggcagggaggctggattctgagagagctgcttccggattgcgttggggtagtcaaggagctcgggacatcgcaggggaggcaaaaagccttggccagtgctcttttggtgtatcccttcagcttccagaggggaagccacaccctgatgctatgttcaaacgctccagaagacaggagttcgtgtccttgcccctaaccactgctgtggatgtcactggccaaaggtcatgaggggagtgggccacatgagtggccacttgccatgactccctgagcagggtgagcccccactcatcctgtgccatgttatgtttccacccaagcagcagggtaggaggcacaatgagtgcccattcctctccctgatgggccccccaagctctacagaccaagcaaggagaccccatgacccatggcatgaaatcatcttgaagtttttgctttttttttggagacagagtatcgctctgtcgcccaggctggaatgcagtggcacaatctcggctcactgcaacctctgcctcccgggttcaagcaattctcctgcctcagcctcatgagtagttgggactacaggcatgtgccaccacatcagcccggctaattttttgtatttttagtagagacagggtttcaccgtgttagccaggatggtcttgatttcctgacctcgtgatccgcccaccccggcctcccaaagtgctgggattacaggcgtgagccaccgcacccagcctactcttacatttttttaggtttttatttactcactgctttaagcatacacgacacttcggttttattcctccctttgtaatgttttttctcttaagccacttttttttttttttgcaatgccttcctctttgaaagcattaaaaaaacagtattttgtttatgtttcaacaacaacaaagaggacttaatgtctggcacactaaaatatttaccaataaaacaaactgatatttggaatttttttaagttttaaaagtgtggtcactgtattgtgatcacacaattacattaggaaaatgtcttattcttagagatgtacattaaagtattaagagtactgagttataatgtctgcaatagagcctcaaatgtttcacaggggactatataaatacatatatatgcctatatatacatatattacatatatacacatatataaaagacaaagagagaaagcaaacagtgattctaggtgaaagacaaagtgagaactcagcaaaaacgtaaattagtacaggtttgttggaaagcaatgtgatgacatctcaaaattggaagaaatttacaaaaactaaaacatgcctaatgcatgtcctttgacccaacaccccttctaggaatttatctttaaaaaactcacacaagaccacaaagcaagaaagggtattaattacaaaaattttttaatggtttaatactcaaatatctaccaataggtggttaggtaaataagttattgcaaatgcttaaaatgaaaaaaaatatatgaaaagaagaaaggggtgtgggtacagatgaaaccgcattggctgtgagtttattacagaagcaatctttgaataatggatatttggatgttcatctcactgtttagtctacttttatatatgtttgacattctccctaacaagtcaaaaacaaaaaagaaccacacaaaattccaagggcacaattctttacaagtggtcatcgaccccctttctttcccaaattaataatatcaacatgggagggaaggttctacactacataaacaagtacacataaatattaaagttctttcagcctgggcaacatagtgagaccctgtctcttaaaaaaagattttcttttagttagctaggtgtggtgattcacatctgcagtcctagctactagagagactgagacagaaggactgcttgagctcaggagttcaaggctgcagtgagccatgatcgtgtgtcactttagcttgcatgacagagtgagactccaactcttcaaaaaagaaaaagttccatcactcttaattattcttacatcctcaggtcatccctgaacagaagagttttgctttcaagcatcttggatccagtagtaagtagatggcagctcacatttactgtgctcccaccagcaagcagctcttcatttctaatagctctagctaaggaaagaaacaagtgtagaaaaagccaggcacagtggccgcgcctgtaaattttagcactttagaaggccaaacaaagcaggaggaccacttgagcccaggagtttgagaccagcctggacaacatagggaaatgggagatcctatctctaccaaaaaaaaaaaaaattgtaaaaaatttgccaggcatggtggctcatgactgtggtcccaactacctgggaggctgaggctggaggatatgtaggcccaggaggtcaaggctgcagtgagcactgatcctgccaccgcattccggcctgggcaacagagcaagacccagtctctcacacacacacacacacacacacacacacacacacacacacacacacataaatgaaagattactgcctgttttgaactttgttttctatggagttgttcagcttttcctattagaagttcaaatatgtgtactacatattgtgccatttctgaattataacaaaagcaagagagcttagaaatcatccagcccagttggccgcagtggctcacgcctgtaatcccagcactttgggaggccgaggcaggtggatcacggggttaggagatcgagaccatcctggctaacacggcgaaacctgtctctactaaaaatacaaaaaattagccgggcgtggtggcgggcacctgtagtcccagctacttgggaggctgaggcaggagaatggcgtgaacccgggaggcgaagcttgcagtgagccaagatcgcaccactgcactccagcctgggtgacagagcgagactccgtctcaataaaaaaaaaaaaaaaaaaagaaatcacccagcccagtatcttgaattaacaaataagcaaaactatccaggcccaaagttattatttcaaattataataacttcagtattctctagttaggaggtattctcctcagtttaatttgaataaactaagtgctcactgaacacctgccacagtgaactgtaatgaataacgagcaaaagttggaagtctgtcttgagggtgctaaactcacagtccaaggccactgactaccatccaaaaccctacagtcattgggctcaagagcccacaaactcaacacctgctcagcaccagcctgcttaaacttgaagcaggaattttcaaaacagcctcctctttctttcagcaagtcatatgatattcattaactttcaaagcaatgagaaaatataatgtaagttaaaattaaccaagactgatagttacatgaagatgtctagttattgggtgttttcccccgctctctggtcctggctgaggcaagcggatcacttgaagtcaggaatttgagggtaaaaccctgtcactactcaaaatataaaaattagccaggtatggtagcacatgcttgtaatcccagctacctgggaggctgaggcaggaggaacacttgaacccaggaggcagaggctgcagtgagcttagatagtgtcactgcactccagcctgggtgacagagtgggactccatcacaaaaaaaaaaaaaaaaaaaaaaaagatggtgtttaaatttttattccaggaacagggttattctttttatattccaatttcaaaagaaaaactctctatatgttctgcatcaagctaataccacaattaaaacgtattcttcacatgatagagaatttaaaataatgatgacacaactagatacttgataatattaaggaattattcattttacatgtgataaacgtattacggcttaaaaagtcatcattttagagatactgaattatttatgaaataatacttgagatttgctataaaacagtgcaatgagggacgcaaaattgtgaacgtgcatgagagcaaagtatagataaaacaagtgggccacgtgttgataattgtgggaaccaagtaacatgatattctctccgtttttccgtatgctcaaatacctccatgataaaaagtaagccaaaaaataaaattatagtaacaaatcagccttctcagagggcataccacagaagcagtagcatcataattagttgttgtaaacacaggtattaaagagcacacagtgactgacagcattatattcatggatgctgctaccctgctgaagaaactgctgcatttgtcagtaccatagaaaggtcaaaaaaaaaaaaaaaagaaaagaaactgctgtatttcagcagcgtgagaggtgattcccatgactaatatccaaaattacatgacattacatccaaaatacattttatatcttagaaatctttctgagaaatcaacaatacttaacaagtatggaatgactataagatcatcaccattagctagatatttccaattcctaaccattcttttcctcaacaacctactccttcaacgagtgctgaagagagaaacaatggtcactggaaattcatcttttaaagttatagatatgaggttttaactcaaaaagaaggaatttcatcaagtattagatcatattcagctactgaaacaaattcatatttcctcgtttcatgttctcaaggcacaaaatactttaccttcatggtactcaggagcatttccttccttccttccttcttcccttccttcctccctccctccctcccttcctccttcccttctttcttctttctctctctctctctctctctcctcctctctttcttttagatggagtctcgctctgtcgccaggctggagtgcagtggcgtgatctcagctcactgaaagctctacctcctgggttcaagcgattctcctgcctcagcctcccaagtagctggaactacaggcatgtgctaccatgcccagttaatttttgaatttttagtagagaaggggtttcaccatgttggccaggatggtcttgattctcttgaccttgtgatccccctgcctcggcctcccagagtgctgggattacaggtgtgagccaccacgcctggccattctttcttttttaaagcaagaatttcatttaatgacctaggtggctttattctgattttcacttttaattatggtagacaaccaaatgatagatctctgaaattttgagacacaacttcttgtgtacaaagagaaatgcagggttctccatcttaagcccctaaagccttcaggagccttcattcacctgtgtaacatagggcctccaccttgatgccagccaacacacacatgtgctaagctgaagcagccatccctggaaccggaaagaatgagaagggaacacaactgtctcaagtttgaggcttccttcttgacaacaatattcacagtacaaaagtactgtgcttagaggagacgtaagtcagataagctgtaacttttcacaaaatgcacaattagtataaagtttaataattttttttcttccagtgtaaattcagtttgtttactgctttgtagttttgaaaagtcaggagttctttttaaattcttgggagctggtctgaatgtagtcaggtcacttttcttatcaaacagcaaaaacttattcgagattacataaaaatgggaaatataaacacatgttacatacagtccgtacactttgagagcatgtcatgcc

SEQ ID NO: 550 - DNA, 16974 bp, Homo sapiens
aggaaaacaacaacagacaaatcctcaacctgttaataagttcaaactgtttgccaattcaactgggaaataatgcattagaaaaaatacctacttgttaacaaagtcattgcatttgtaactaaagagatcacacacaactgtgccatctggtcacaaaacagaagataaggacaagtttctttttataaaagtattccagctaataaatgatgaaggaatgacagactctcttattaaattactggacctaggtgttgaccatcaataacagagacacatcaatcacaagagacaacctgaaacatcatgtgcctcttaatggaagaacacaacaccaactattgaactatctttcaaaaaaaaaaatcaaacttgaatctgattgagcttctaaacaccacagagaagttagaggaacatgtttgtttgttttttgagacggagtctcgctctgtggcccaggctggaatgcagtggggccatcttggctcaccacaatctccgcctcctggattcaagcaattctctggcctcagcctcccaagtagctgggattacaggtgtgcaccatcacgcccagctaatttttatatttttagtagagatggggtttcactgtgttggccgggctggtctcaaactcccgacctcaggtgatctgcccaccttggcttcccaaagtgctgggattacaggcatgagccactacgccccgcctagaggaacatgttaaccaccacaatggtgagccaatcagcaaaatcaaactctggaaaacaccattaagacaaactacctggttttatcaaacaaattggaaagaaaaaaagagcaagaaattgaaaaggacactataggttaaaagagatttaaaatgaaattttaaaaacaatttgaaaaaaatctattcactgtagcatcaagaaagaaagaaagaaagaaaagaaagcaagaaaaaaaaaaggaaaaggaaagaaaaggaaaagaaaagcctgtacactgaaactggaaaatatggcttagttaactaaaaaaatacctaaataaatggagaggcatacgatattcacagactaaaagatccaaagatgccaaaggtaattcaatggaaatggaaaaaggatagtattttcaacaaatggtacagaaacaactggatatccacatggacaaaaatgaacctcaaccttacctcataccatacataaaaactcaaaatggaccataaacctaaatgtaagagccaatattttttaatatccagaaaaagaaaatagaaaatctttctgagcttggactggcaaagaatttttatttttattttgaggcagggtcttgctctgtcgccaagtttggaatgcaatgggcacgatcactgctcactgcagccttgacctcctgggctcaaataatcctcccattctcagcctaccaagtagctaggactacaggcatatgccaccatgccttgctaactttgtttatgttttgtagagaagtggtcgaagtggtctcactatgctgccaggctggtctcaaactcctaaactcaagtgatccttctgcctcagcctcccaaagtgctgggattacaagtgtgagctattgcacccagcctggcaaataactttaaaacatgacaccagaaaaagcacaaacaataaattgggactgtatcaaagtttaaaacgtttgctcttcaggccaggtgccaccccccagctcacgcctataatcttagcactttgggaggctgaggcgggtggatcacctcaggtcaggagttcgagaccagcctggccaacatggtgaaaccccgtctctactaaaaatacaaaaattagccaggacagtggtatgtgcctgtagtcccagttacttaggaggctgaggcagaagaatcacttgaacccgggaggcggaggttgcagtgagccaagatcacaccactacactctagcctgggcaacagggtgagactccatctcaaaaaaaaacaaaacttttgctcttcaaagacacaatgaagaaaaaagacaagccagaggcttaaaaagaaatttttttgcaaaacatatacctaatatggatttatatcaaaaagctcttaaaaataaacaatcctttttttttttttttttttttttgagacagggtctccctctggtcactgggctgcagtgcagtagcaccatcttggctcactgcagcctcaacctcctgggttcaagtgatcctcctgcctcagacctgccaagtagctgggactacaggcgcacgccaccacacccagctaatttttgtatttttttagtagagacagagtttcacctattacccaggctggtctcgagttcctgagctcaagcgatctgcccacctcagcctcccaaatgctaggattataggcatgaggcaccacacccggacaataatccaatttttcaatcaaaagatttgaataggtacttcagcaaagaaaatatatgaatggcaagcacatgaaaagataattagtcactagggaaatacaaattaaaaccactatgaagtatcattacacaccaactaaaatggctaaaatacgaacaataggaaatttaataaggatggagaagtgagtcctcatacaatgctggtgcaaatgtaaaaatggtacagccactttgaaaatggtttggcaatttcttaaaaagctaaacacaggccgggcacggtggctcacgcctgtaatcccagcactttgggaggcagagatgggcagatcatgaggtcaggagattgagaccatcctggctaaaacggtgaaaccccatctctactaaaaatacaaaaaattagccgggcgtagtggcggtcgcctgcagtcccagctactccggaggctgaggcagaagaatagcttgaacctgggaggcggagcctgcagtgagccgagatcgcaccactgcactccagcctgggcgactgagcgagactcagtctcaaaaaaaaacaaaaacaaaaacaaaaaaaaagctaaacatagacttatcatacaaccaagcaattccactcttgaggatcaccaaaaagaaatgaaaacagccacacaaagactttacttgtgttcactgccaagaactagaaataacccaaatgtccatcaactagtgaatggataaacaaaacgttttacctatttatacaatggaattattctcccagcactttgggaggccgaggggggcggatcacgaggtcaggagatcggtaccatcctggctaacactgtgaaacccgtctctactaaaaacacaaaaaattagtctgatgtggtggcaggcacctgtagtcccagctactcgggaggctgaggcaggagaatggcgtgaacccagaaggcggagcttgtagtgagccgagatcatgccactgcactccagcctgggtgacagagcgagagtccatctcaaaaaaaaaaagaaaaggaattattctcagcaataaaaacaaactactgatacatgcaataacaaggataaatctcaaaaacttcatgctatatgaaacatgccagacacaaaagactacatattggatgattctatttatgtgaaatttctagaaaaggcaaaattgtatagaaaatacatcagtggtttcccagaatcaggatgcattgtctgtaaatgaccacattttgggggtaataaaatgttctaaaactaaatggtgatgatggttgcataactctatacaattactaaaattcatcaagtaggtcacttacaatataaaacatgcttcaataaaacattgtttaaaaaaagagagaagataacacaacgtgttggtcaattggatcctttaaacaatattttttaaatttatttttgttattgtaaaatacacataaaatttaccattctaatcaccttagatgtatagttctgtggcattaaggacattcacaatgttgtacaagaaaattttttaaattacagcatgtataacaatgggaactgagctctgcataaattctagtgttcataagaaaaaatgtagatcaggtcgggcacggtggctcacgcctgtaatcccagcactttgggaggccaagacgggcagatcacgaggccaacacggagaaaccccgtctctactaaaaatacaaaaaatttgccgggcgtggtggcgggcgcctgtagtcccagctactccggaggctgaggcaggagaatggcatgaacccaggaggtgaagcttgcggtgagccgagatcgcgccactgcactctagcctgggtgacagagagagactccgtctcaaaaaaaagaaaagaaaagaaaaaatgtagatcaataatattattttgctgacgcattggagaaagtaaaggctgggtgcagcttcaagctgaggaccacccaccatgcccccatcatggtggttcccctaggtgctgaagggcccagccatagctctcgccctcgcagggtccctccagggtctctgctgtttcctacctaggggtgactgcagccatggctaagaaagcgccagcgcccacccacctgggccaatggactggttctgctcgtgccacgctggttctgctcctcgccatctcggcagttcagaaagaaccccaacgagcttgtgatctcccgggtcctgtgggcgtatcaacagggggccagccctgtccctcaaccctggggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcctctgaccaggcctgcggggaggagccacccacgcgccacagcaagtcctggacctggccctgcattccagggtggggcagggaggctggattctgagagagctgcttccggattgcgttggggtagtcaaggagctcgggacatcgcaggggaggcaaaaagccttggccagtgctcttttggtgtatcccttcagcttccagaggggaagccacaccctgatgctatgttcaaacgctccagaagacaggagttcgtgtccttgcccctaaccactgctgtggatgtcactggccaaaggtcatgaggggagtgggccacatgagtggccacttgccatgactccctgagcagggtgagcccccactcatcctgtgccatgttatgtttccacccaagcagcagggtaggaggcacaatgagtgcccattcctctccctgatgggccccccaagctctacagaccaagcaaggagaccccatgacccatggcatgaaatcatcttgaagtttttgctttttttttggagacagagtatcgctctgtcgcccaggctggaatgcagtggcacaatctcggctcactgcaacctctgcctcccgggttcaagcaattctcctgcctcagcctcatgagtagttgggactacaggcatgtgccaccacatcagcccggctaattttttgtatttttagtagagacagggtttcaccgtgttagccaggatggtcttgatttcctgacctcgtgatccgcccaccccggcctcccaaagtgctgggattacaggcgtgagccaccgcacccagcctactcttacatttttttaggtttttatttactcactgctttaagcatacacgacacttcggttttattcctccctttgtaatgttttttctcttaagccacttttttttttttttgcaatgccttcctctttgaaagcattaaaaaaacagtattttgtttatgtttcaacaacaacaaagaggacttaatgtctggcacactaaaatatttaccaataaaacaaactgatatttggaatttttttaagttttaaaagtgtggtcactgtattgtgatcacacaattacattaggaaaatgtcttattcttagagatgtacattaaagtattaagagtactgagttataatgtctgcaatagagcctcaaatgtttcacaggggactatataaatacatatatatgcctatatatacatatattacatatatacacatatataaaagacaaagagagaaagcaaacagtgattctaggtgaaagacaaagtgagaactcagcaaaaacgtaaattagtacaggtttgttggaaagcaatgtgatgacatctcaaaattggaagaaatttacaaaaactaaaacatgcctaatgcatgtcctttgacccaacaccccttctaggaatttatctttaaaaaactcacacaagaccacaaagcaagaaagggtattaattacaaaaattttttaatggtttaatactcaaatatctaccaataggtggttaggtaaataagttattgcaaatgcttaaaatgaaaaaaaatatatgaaaagaagaaaggggtgtgggtacagatgaaaccgcattggctgtgagtttattacagaagcaatctttgaataatggatatttggatgttcatctcactgtttagtctacttttatatatgtttgacattctccctaacaagtcaaaaacaaaaaagaaccacacaaaattccaagggcacaattctttacaagtggtcatcgaccccctttctttcccaaattaataatatcaacatgggagggaaggttctacactacataaacaagtacacataaatattaaagttctttcagcctgggcaacatagtgagaccctgtctcttaaaaaaagattttcttttagttagctaggtgtggtgattcacatctgcagtcctagctactagagagactgagacagaaggactgcttgagctcaggagttcaaggctgcagtgagccatgatcgtgtgtcactttagcttgcatgacagagtgagactccaactcttcaaaaaagaaaaagttccatcactcttaattattcttacatcctcaggtcatccctgaacagaagagttttgctttcaagcatcttggatccagtagtaagtagatggcagctcacatttactgtgctcccaccagcaagcagctcttcatttctaatagctctagctaaggaaagaaacaagtgtagaaaaagccaggcacagtggccgcgcctgtaaattttagcactttagaaggccaaacaaagcaggaggaccacttgagcccaggagtttgagaccagcctggacaacatagggaaatgggagatcctatctctaccaaaaaaaaaaaaaattgtaaaaaatttgccaggcatggtggctcatgactgtggtcccaactacctgggaggctgaggctggaggatatgtaggcccaggaggtcaaggctgcagtgagcactgatcctgccaccgcattccggcctgggcaacagagcaagacccagtctctcacacacacacacacacacacacacacacacacacacacacacacacataaatgaaagattactgcctgttttgaactttgttttctatggagttgttcagcttttcctattagaagttcaaatatgtgtactacatattgtgccatttctgaattataacaaaagcaagagagcttagaaatcatccagcccagttggccgcagtggctcacgcctgtaatcccagcactttgggaggccgaggcaggtggatcacggggttaggagatcgagaccatcctggctaacacggcgaaacctgtctctactaaaaatacaaaaaattagccgggcgtggtggcgggcacctgtagtcccagctacttgggaggctgaggcaggagaatggcgtgaacccgggaggcgaagcttgcagtgagccaagatcgcaccactgcactccagcctgggtgacagagcgagactccgtctcaataaaaaaaaaaaaaaaaaaagaaatcacccagcccagtatcttgaattaacaaataagcaaaactatccaggcccaaagttattatttcaaattataataacttcagtattctctagttaggaggtattctcctcagtttaatttgaataaactaagtgctcactgaacacctgccacagtgaactgtaatgaataacgagcaaaagttggaagtctgtcttgagggtgctaaactcacagtccaaggccactgactaccatccaaaaccctacagtcattgggctcaagagcccacaaactcaacacctgctcagcaccagcctgcttaaacttgaagcaggaattttcaaaacagcctcctctttctttcagcaagtcatatgatattcattaactttcaaagcaatgagaaaatataatgtaagttaaaattaaccaagactgatagttacatgaagatgtctagttattgggtgttttcccccgctctctggtcctggctgaggcaagcggatcacttgaagtcaggaatttgagggtaaaaccctgtcactactcaaaatataaaaattagccaggtatggtagcacatgcttgtaatcccagctacctgggaggctgaggcaggaggaacacttgaacccaggaggcagaggctgcagtgagcttagatagtgtcactgcactccagcctgggtgacagagtgggactccatcacaaaaaaaaaaaaaaaaaaaaaaaagatggtgtttaaatttttattccaggaacagggttattctttttatattccaatttcaaaagaaaaactctctatatgttctgcatcaagctaataccacaattaaaacgtattcttcacatgatagagaatttaaaataatgatgacacaactagatacttgataatattaaggaattattcattttacatgtgataaacgtattacggcttaaaaagtcatcattttagagatactgaattatttatgaaataatacttgagatttgctataaaacagtgcaatgagggacgcaaaattgtgaacgtgcatgagagcaaagtatagataaaacaagtgggccacgtgttgataattgtgggaaccaagtaacatgatattctctccgtttttccgtatgctcaaatacctccatgataaaaagtaagccaaaaaataaaattatagtaacaaatcagccttctcagagggcataccacagaagcagtagcatcataattagttgttgtaaacacaggtattaaagagcacacagtgactgacagcattatattcatggatgctgctaccctgctgaagaaactgctgcatttgtcagtaccatagaaaggtcaaaaaaaaaaaaaaaagaaaagaaactgctgtatttcagcagcgtgagaggtgattcccatgactaatatccaaaattacatgacattacatccaaaatacattttatatcttagaaatctttctgagaaatcaacaatacttaacaagtatggaatgactataagatcatcaccattagctagatatttccaattcctaaccattcttttcctcaacaacctactccttcaacgagtgctgaagagagaaacaatggtcactggaaattcatcttttaaagttatagatatgaggttttaactcaaaaagaaggaatttcatcaagtattagatcatattcagctactgaaacaaattcatatttcctcgtttcatgttctcaaggcacaaaatactttaccttcatggtactcaggagcatttccttccttccttccttcttcccttccttcctccctccctccctcccttcctccttcccttctttcttctttctctctctctctctctctctcctcctctctttcttttagatggagtctcgctctgtcgccaggctggagtgcagtggcgtgatctcagctcactgaaagctctacctcctgggttcaagcgattctcctgcctcagcctcccaagtagctggaactacaggcatgtgctaccatgcccagttaatttttgaatttttagtagagaaggggtttcaccatgttggccaggatggtcttgattctcttgaccttgtgatccccctgcctcggcctcccagagtgctgggattacaggtgtgagccaccacgcctggccattctttcttttttaaagcaagaatttcatttaatgacctaggtggctttattctgattttcacttttaattatggtagacaaccaaatgatagatctctgaaattttgagacacaacttcttgtgtacaaagagaaatgcagggttctccatcttaagcccctaaagccttcaggagccttcattcacctgtgtaacatagggcctccaccttgatgccagccaacacacacatgtgctaagctgaagcagccatccctggaaccggaaagaatgagaagggaacacaactgtctcaagtttgaggcttccttcttgacaacaatattcacagtacaaaagtactgtgcttagaggagacgtaagtcagataagctgtaacttttcacaaaatgcacaattagtataaagtttaataattttttttcttccagtgtaaattcagtttgtttactgctttgtagttttgaaaagtcaggagttctttttaaattcttgggagctggtctgaatgtagtcaggtcacttttcttatcaaacagcaaaaacttattcgagattacataaaaatgggaaatataaacacatgttacatacagtccgtacactttgagagcatgtcatgccagttggaaaaacctaacagcaacttacaatggtaaatgatgactaccaaatgctctgaataggctgtacgcatgatgggagtaaagtgaagagggggtttaagccatgtgggtttttttgtttgtttaagagacaggatctcactctgtcacccaggccgaagtgcagtggtacaatcatagctcactacagccttaaactcctgggcccaaatgatcctcctaccttatcctgccatacggtagctaggactacaggtgcatgccagcacatcctgctaattgttattgtagaaacaggattgggtctcactgtgttgcccaggctggtctcaaactcctggcctcaaatgatcctcccaccttggccttccgaagtgttgggattacaggcaggagccacagagcccagctgggatttaattttgaaaaacagaggagaggaagagaattccaggcaggaggataaaagcaaaaacatagagatgacaacacacaacatgtgtttcaggcacagtgactagaccaatttggctggggtactttttctcctttgttgtcatctttatttttctacctgggatgtaaacgatgtgaatatgggtcagaaaaatcagctgcacagaaacacctcagccaattgtaagacagagagagggtggacatgcatgaaggggcagtagcaattccagaccagccttctgaaagagcctgtggtccaagccggcaaccagaagggcactctgggtggggcaggcaggaccatgcaatgcaggttcttgggaggaaggatgaggaggagcagtcacagcagatgctgtggctgagctccaacaagtttattggactctgccttcaagctgctgcctgaagaagttgattagcccattggcggaagcatagtgagaggtcacttcaaggcaagcaacaagaaaagactagaaagctaggttggagttagcctggaggccttatataccaagagtttgaatttcagactgaaggcttctgaatgggattaaaatgacaggaaagtaagcagcagtgcacatatacagagatcagagactgatgttcaggacggaatggggaggaagagcctggaggttagttctcaggggatgtttactttagcaatcataaagagtccaggcctggcgcggtggctcacgcctgtaatcccagcactttcggaggccaaggtgggcagatcacgaggtcaggagctcaagaccagcctgaccatcatggtgaaaccccgtctctactaaaaatagaaaaatcagccgggcgtgttggcacgtgcctgtaaccccagctactcaggaggctaaagcaggaaaatcacttgaacccgggagacagaggttgtagtgagccgagatcctgccactgtactccagcctgggcgacagagcaaaactccgtctcaaaaaaaaaaaaagtatacaggaggatgtgtgtagattatatccaaatattacgtcattttatataagggtcttgagcatctatgaattttggatatggaggggtcctggaaccaatcccctgcaaacaccaagggaagactgtacttcatttatgtaagcttccacagtttacaaaggacttttgcttacataatctcattttaccttcagaacaatttgtaaagtagaacatttgctatatttcacaagtgaggaattgctgctccgggcagttccttttatgaccaccattccatgtttcattttatggctctgtctctcaaccagtagactgtaagctccatgagggtatgcagggaccacactgaattttgtttgcctttgtagccctggctgcctcatgaagagccctggtccctgatcccagcagacacatgctcactaaatatgtgacagatgggtgaggagcacatcccctctcccactcttgtttcaatgatactaaaatgctttatcaatcaaaagtgtttgggggctttttgtgtttgttttaaattattgttctgacaattaaaaggctttgacaattttaatacctctacttagcactttctaaacaagacctcttttcccccgctaggtaggaaaaaggaaaaatatacaaaaaaggaatatcaggctgcctgccaccttcaccgttgtatcaaaaagtcactctaagtgatatattagactaaggaccaaaaaaaggtcaatatttgctaattattttttcaaatatcttctatttctttgcagaatggaatgtatgctgaaacaaataaccacacatatgagtacctacagtgccagagttgagaaattctggcctagaacacttgtgccagaaaacaagaaaatgctccaagaataatggagacatgtcaaaaggacaaagcagcagcttgaagggcctcccactggccaagtctgagacaatttaagcatcaatacaaataataaaagattatagctcattgattaaaataaaaaacatgagttcatattgatataaattaataaatcaataaattgaaaatgtgatgaagaatgagatagttaacataatttggaagtacttatccataaaataccaattacaaatggaagaataatttagcagtagaaaaatgcaaaaaattgaaattgtatgtcacctactaggaggcaatgagacataacatcatttctgccatatttctgccaaagatacgcaacctgagtttaatcatgagaaaacatgagacaaacccaaattgaaggacaggctacaaaataactggcttataatttccaacccatcaagaccatgaaagtcaaaagaaggctgagaaagacttggcaactaaaagcaaagcatgtgaatctgaactgaatccttttgcttgccccacccccgcaaaaaaaaaaaaaggcggtggggaaaggagctggaaggtctttattgggactattggtcaaacttgaatggggaatgggggggtgtgaggagtatttgatggtaatataatgtgtcaatgttaatttcctgcttttgatggttatgttgtacttatgtagaagaatgtccttaccattggaaacatacacacactagggtaattccagagtgatggagcatcaggcggacaactccaacggttctggagaagaaaacaagttttctctactgtacttgtaactattctgttttgggctgtttcaaaagttttcaaaaacattttaaatgattagtatctctccaaaatgaaagtaatggatacaatcttaatacatacacacaaattctttccaacaagaatgttctctttgtaaaagtactaaataagtcttccatttggtcactagggaagtagtataaaatagtgttgcataacaaaaaagaaaaaccaggctttccatgtagtaacactgacttcaagctccagttcatcacatacaaatttcatgaccctaggtagacttttttttttttttttgagatagagtctcgctctgtcacccaggctggagtgcagtggcgcgatctaagctcactgcaagctccgcctcccaggtttacttacaccattctcctgcctcagcctcccgagtagctgggactacaaggcacccgccaccacgcccggctaattttttgtatttttagtagagacggggtttcaccgtgttagccaggatggtctccatctcctgacctcatgatgtgcccacctcggcctcccaaagtgctgggattacaggcgtgagccaccgtgcccggccggaagattttgtttacccttctgggtcttgatatcctactctgtaaagtgagaataccagccaggcatggtggctcatgcctgtaatcccaactactcgggaggcttgaggtgggaggatcacttgagcccaggagttggagatcaatctgggcaacatagcaagaccctgtgtctataacaaggaagaaaatgaaaaaagaaaaaacaggaagtgagaataccacttttggctgggcacggtggcttatgcctgtaatcccggcactttgggaggctgaggtgggcagatcacttaaggtcgggagttcaagaccagccaggccaacatggtaaaaccccgtctgtactaaaaataaaaaattagcccagtgcatggtgacatatgcctgtaatctcagctactcgggaggctgaggcaggagaattgcttgaacccgggaggcagagattgcagtgagccgagatcacgccactgcactccagagactccatctcaaaaaataaataaataaataaaagaatccctcactttgaacaacaaaagttgttaatctgctgagaatacaggagaatacaagggtgggaggaaatctggtgctagataatacaatccttcactctttcagtaagtttggtttttaaacacatgaatcacttattcattcaacaaatatttacagttgacccttgaacaacacaggcgtcaggattaccaactgccctcacaggaaaaaatctgcatgtaacttctgactccccaaaactttactaatagcctacagctgaccagaagccttactgataacataaaccgtggattaacatgttttgtatatgtattatacactgtattcttacaataaaataaactagagaaaacaaaatattagaaaaattataaggaagagaaaatatatttactattcactaagtggaatggattatcataaaggttttcatcctcacggtcttcacactgagtaggctgaaaaggaagaggatgggttggtcttgctgtctcaggggttgcagaggcagaagaaaatccacataaagtggacccatgtgatttgccctgtgctgttcaaggtcaactatatttggtttctatactatgctctactatgtagcagctacagagatttaaaacatgatccctttgcctcaagccaataggaaacaagctaaaagcaagcaatcataatgaaaaggaaggatgttttaagtagtaaaggagaaagaaaaaagaaactcaaatggattctctcattctcaacaaacaagcaagtgaaacttctttgggtaaagagagaacaaccagaaagctattctggctcttcagtgctcctactgcaaggagtgcaagggggtgtggtgcaggaagcctgagctacctatcccaggggaggacaaagggagacaaaggcatcaagagagagcagctgggcagtgaccgaacatggctgccaggccaggggaaagtagcacatgggtcctgactgaaccctctgtggggctggtaagccctttctagtccagagatgcttttgggaggaggaggtgagtggcagaaagaaaattatacaagaaattttcttaatgttctttacacaatatacatggggaaaatgcacaagggggtaattgtggagccatgtttcaaagtaagatgacattcacttaatttgtacaaccagaatacagtgtgtttttctgtaatgatgttatttatagcctagtacttgtttgacagtacctgactgagaaagtgacaaacatctctgtatatatagaacttaacttataaaacatgtttaaataaggtaatttgcccaaagcttctccattgaattttaattccacaatatttgttataccatatcaacaaaatgacaccagataaaaaagaccactaagctcagaaacatctatttggtatctgtatcttcggaactgtcttccactcagtatttaccaacacagttaaaaaccagcatatttacaatgcttctttaccagcctgctagcaacttgtctctatctactactgagcacctcctttgttcttggtacttcccaggggatgatggggtggcccaataggaagctcagtcttg

SEQ ID NO: 551 - DNA, 1289 bp, Homo sapiens
agatcacaagttactctgaaacagtaaaacttctggatcaactgggtaacactattggttccctgtgtttgtattctggtcccagaggctctgtggtgatagagactgagataagagacaagtaaaatagtgtccctttcgtcaaaagtctaccaggaataggactttcacgaaatgctgacagagctcgtgtaaggtaaaatgtaactactccaggctttgggagggagggaggtggagatgtgaataggtgttgtcctaagatgctagaatggtagaagtttatttcaactcctaggaagagctacctgttatgaccctaaaaataacatctttgctgcaggagacatgaagaatctctcagataatccatgaattctagaatgcaaggaatggaatggagtataaagatcatctgccccagtgccttttgattgtttctgccagtcatttgccagcctgccctcaggaccattccacaggctcttctgcctaaatttgagactctgttcagagactgaacagtagggggaagacaccaggctttgttgtcctctttgtgggtgtaacagcatctcctctgaagctccaggtctctccagacagccctctcttccacattccagctcctgctatctcccctgctgtgacttctgcttgtaacagctagccctagactcggccaacaccatttccttcctctcctatggctcacggaagattcctgctgttgtccatccatctctgtgttgcctcccaagcctgtgtgccttacaatctttccggccctttgttaaattctattaaatgacctcacaaaatccctgtcttcctgactggcccttactgacacagtgcttcacaggctgaaggtgaaggggaatggcagtgatccacttttaaaaaggtctttgggaccctatactggagaagtttcccagttagtcacatgtttcaaatactggggtttcaagatataaagggaccactggggtccaatcacctcagtttacagtcaggaacctggaggcctgatgagggaaagtgtcttgcctagggatcatatagtaagccagaggcctgatgaaagctggactaattcccagcttttttccttccttcacatggattttggcaaagtgaccgtgataggaacagcatcacattcttaaactagctggggtaggtgggcacctaggttttgttccctttggacttgtacaatatccttgccatcattcccttccttcctgcgtttctttgatagagcaaacatttctaagcttgga

SEQ ID NO: 552 - DNA, 5375445 bp, Homo sapiens (residues 1-1,791,815 of 5,375,445)
  misc_feature (865621)..(1125620): n is a, c, g, or t
gggagacattagtcaggtaaacatacagataatatgcttggagtgattatgatgaatggcaatgagaaatagagtgctatgagactgtaaggaaggtccctctgaccatccctggacacaaaagaaaattatgaaatgtctgaagttaaaaagagaatgttgatgctagagagcaatagagagtcagctctaggacagaccaagggcagtgagaggcaagccaaaccagctaggtaagtttcatttgagaatcctcctttttaagactcccaacatagaccttggatatagttgagaataagaaaagttaagtcttccagagaaaggaacaccgtctacactctgaataaagacctatcagacagaaaatccttagcgaccccaaacatggttaagtttgctctcaaggaagaactccatgagcatctgcccatttcctcttgtgtccccagcaaggggcagggccccagtgcctcctgtgggaggctgaagaaccatagagcactatcattgtccttaacaggctcacagcaatgaacaataggagtaatgcatttatccaagaacatagttgtgaaatagacaaatcatgttcaaggacagtgactctcagcagaaagaaaggagacacgtgagatttgaaaaaggattccatatcataaaccaaaaaaaatgacaactatttggctggtgcagaaacacagaagaaagtgaaaaatatagaggaaactcgggttttaaaaaggcctacaaatgcctcatctagaggagagacccagggtagtgatggaaagtaaccttgttggggacaaggtctttggggtcagtccaatagaccagtgtctgaatgccaacactgccactcacaagcttcaagggacaggactctggacatattacttcacttttctgagcatcagacaccacttttaagtaacagcaatattaatactgcctacttcagtgactagttctgatgaagagaaaataattggaaagaactttgtgtttactggtacacagtaaacaaggactcttagctattgccattgctatcattggcactttgatgggtagggactttgatgggtagggaaggtatggatagattgggctcttaaggactaatatcaccttaatagccaaataatagttatcttctacagagtattgattgagtgccagatattatgctgagctctttccaacattcgtcctcagtccttgtacagtgaggatgttctattataacccccatgtacagatgccatcactgaagtataaagaagttaggttactagtttaggctcatatagctgagaagtagcaaagcagggattgactctgtacatctaattcaaactccccacacttcctcaggtctgtccaaacctaggaatccccctggagactttttcaaagactttatctcaaggcccagatctagagcctcccattcagtaagtctgctgggaagcccaagaatcagtatgtttaaagctctccaggtgatcctagagataaaaagaatccagaaaccccagctgtagaaaaccaaggccctggaagagagttaactgtagcccccctccttcaccatggccttcagagtagacagagccatgtctcccaccaatatcaaagaattgttttcctgcagtacaaactcacttgggaccaggtataactcagcaggcagggactcactccaggtgccaattctctacatcaaaggcaagagttttctctgcccaggcataagggccactcaaatattaatttcagtcccattataaatcatgagttgtagcttgtgaccatagtcctttaaaatatcttgagcttcatagacagatgaagtctgtgacctagctcttcctcctttcatcccactctctcatacaatgttaggctacctattaaaaaccatcccttgtcccccagatcatggtcgggccaaggagataaccaatcttctccacgtgactcaaggccaaaaggtcccattgtgattctccatgcaggctcagagcagaggagttaatggtgtaagtggtcttgttgtatgcttggcacaaattcactgcaacaagtaaaagctctattgattttttggaaacacttaaaatgaactttgctctcagcaggcagctaaccaagactagaagttgttctctataatctgtaaaaccaacagagctgagggctgtgtacatgtggctgtcagctcagtccaaacgaagcaaccattttcaccatatgatcccagcaagtcattaaaggtgtgtggcacctatgcttatagattaataactcaggaaaatgcatccaacagcatccaaagtcaatgggcaccaggttaatccaagcctggactgtctatgcagtgacaccactcagctgctaaattctttcccccttttctagtataacttcccagcagtcattgctgctgcctgcacagcaataaaacttgtttagacaagcgtttgaagcacattgttcacacaacaatagaaagagagacactgagaaaaagttcccagctttgactgatgtgtgaaacagcccaaggtgacatattataaaatatttagttgaaacaatgcatatagctggagcccttgagcaaatataaacactagcaccttcgtggcaatttcttcgttataggctggtggtttttccatactattacttttgcttcatccttcttgatagagtacattttgagacttcctccactgacattcatggatttttcatacagatgtttaactctgttcaagaagcataggggcaatgccctttgaaggctcaaatgccttattttctgcacaagggaaggtttcagggtaagcaatgctatttggtggcaatttacttcaatctgtgagatggagctcttcaggatgtgaacaggcaggaaagcaaactgcctttcagctctattccctccactcctgcctggaatatgtatttaaaacaagccaccagcatgttaaataccccatccctgaatttcagatgaacaagcaaaaaccatgaaagtaaatataagcaggcaaacttaggggatagctactataagatttttctatccctatttctcttttctctacataaacgtgctaaatataactatgtgtcctaaacttacacttttgtgccattggggaaatttattttcttttagtaagcgttatttccatatttttacaatctattccttgtctctattttaagcacattcgagtgacaaacatgtactgagcacatcctttgtgaagaacacacggctcctactcataaaaacctaaaatcaaggtaaagcgtgcatctcagtcttccttagttctgctaaagaagcagcagtcttcaaataatcatttgagtattgccattttccaagatattggggcaacctcctggtttctgtgttgtttgcttgtctgtctgagctacttaagccaacaacaatctgtgggttgcaggcaaagatggtcatgggtattaaaaccaaaataacacagatagagaaaggaaaagaaatgagtagacagttgatggtcatctcccatgcttcctcccacttctttctctacaggcttccattttcatttagagacccacatggctctgggaagctgagcccacccaccccaagccacacattccatccacttggtcacaattcaggagcaggtaagtatttaagaaaaaatgttggtttggctatgaatgggacagagagccaaagttaccattggcttaaacaagatcaaagcttatttctctgtcacataaaactcaagttcgtataatggctatgctctgtggagtcatcagggggccacaagcaccttctatcttgttgctgttccattcttaagagtgctgctcttgtctgtgtggtctcaggattgctgacaactaggaaagctcccatgtttcctcttctttagtttaggggcaaaacaccagaattgcacacaatacctttcacttatatcttattggctaaaacttagtcacatggccacgctagcagcaagggaagatggaaaatatagtctttttatcaggcatttatgtgcctggataaaattccattactagaaaagaaggggatagaagatatgagaggtcaacccagtagcctcttccaggcttgtggcctagactattttaggtcctcatgttttggtttggtatcctgaaaaacaggtgcatattctcccccaggatgtacggtttactgaagtgggaacttggccatttttgcaatcataaggaaaataatcttaggatgacaaagacagtagaagcaagtgaatcttagagaaaaggatctggttatcaggtgatattataaacttctagatcaaactacatctgaagctctatctctagacttttcacgtatgccagccagtaattctccttattttcaaaagcagctcgaactaggattttcttactttcaattgagatatcctaagatatatagaggaaaagggatagagaaagagatggggagagagactgcaagagaaatagaggaagataccagatggccactaacccaaaattttaacaaaagccagtttcagacacaggaagggtgtaaactacttacaacagatgagctaaacattaacaaaaacacagaatgatccaaatattagcaaaactccttagaacagagaatagatgacaaagaatagccggtattgagcagccaaaaagcataatgttttaaataattctttccaaagctgctcatatgaattgaactctattatcacatcaccctcttctctacttccttccatagagaagagtttgttgggtgaaataatacccttaatataaaagcctcattagattagcaattattctagatcaaagccttgggtagatgcccctggccttgattctttgacaaattatattgtggtggccaatgtgaggccttgaaaactagttttgtaatcttccaagtatttagtctaaggctccttcaactcttagccctgaggacaagaccaagcaattacaacccttctggactttatttttccctaagatcatcatcaggaatttattaagcaaattttacagtataaatgctgatgaaataggcaccatttttagaaaactaggatctgcttgttttggtagacatctcacctaaaattctttccattttattgatgtctagactaagaagatataagaggaggagtaagaactgacagtcatgtggattaaagttagtattctcttatcgcaaaagggttattcagattcaaaaacaaaagtctgacacgccagtggatatttttatgtattattttgcatgtgagacaggtgggagatggagccaggctgttgagtgcaggttacggaacaaaacgcccattcattcattccccaaatattgcctctagcatgaactgctctgggtattgaggctatggcattaactaaaacagagtaaaacaacactgttctcagggaccttagttggtgctaagggctaaggagaagaaaatgttgtaagtagttttgtgatagcaggagaggggagtctgttttaagtagagcagagaaaggctcccagaaaaggtgacacatccacagtaaaggaagggatgagggtgacaccaacaagccccgcttttttccaagatgctttagcacactctactttacttgataagttagagctttgccaatggttatcctagcacaagggtaagtggcaagggtattgtttaagtcaatcacgattcactccccaggcttcagcacgttgctgccctagtggttttttctgaaaaaaccattttttcagaaaagcacccacaaattatgatggtttattccacccctgccaggccaaactcatctaaagtgaaatactttcatgataactgaaaagagttaccataattgacaagcttctatgtcagagagacaaaacttgcaggtgagccatagggcaaatgcacattcacccatcggaagaatctaaccttctttacatcatcatttctcagaggcagatggataagtgaaatctggcttcttcttgctgaaggctcttcaaggacatcaaccaataaaaccacttgacaattcaaccaaagcatactgtcactgcccctacatacttctgatcttgcttcactcaccatcataattcaggagaccacttcatagtctggggaggtagcacaaaatgttctcacatttcaaaaccacagataccatgcaccttagcatttagcatagaatgaatcccttttttcattatttttcaaatttgattttttgggttactatttctcattcctggttgggccagagagactctagagatacattctacaatgaaaaacattttaaaatctaacaaaagtgcaagacagagagttttttcagttaattcaggaaaagtagatgctttttaagagagcttcttaccaatgaagtcatgaggtggtatggtgtgttagaaaagcagagagcatctgaatgcttgaatcctaagccccatgtttccaggtataagcccttaggcatgaagcaattcatctgtgtggggttgagatatttcctgccaacattatgggtttgggtggtgggctgggattgaccaaaaaacatggtattttgtgtggaagtgcttttaaatagctacattttattgtgtgacccgtatgtgagagatgctacaatgcaccctttactcgcacgttatttaagcccaaactctgtggcaggtactgttatcgctattttatagctggggaaaatgggtaatcagaataaatacacagaaaattatggagccaggattccaatttggatttgtatggctctttccaccagtggcttataattttcaattcagaatctcaacaggcagagtggcacatgcctgtaatcccagctacttgggaggatgaggcaggaagatcgcttgaaccccggaggtagaggctgtattgagctatgatcacaccattacactccagtctgggcgacagagtaagactctgtctctaagaaaaaaaaaaaagaagtcttactaacacgggccatttggggtttcatagttcggggtgaagttttaggaggggaataaagtaactgaaacagactaagttgaaaaaaaataaagggattacacaattgaagttacaagaatttcagaagccaacaatcttcagacagagaagcatattgacatttttggacagatatggaaaaccaaagacatgggaattacaaggagaaaatgtgccttttagaaatgaggggcaggaggagggaagaacagcacaagctgggggagtaattacagcaggacacatttagtctcagacagttctttgataaccagaaaacaacacattataaagttagagatttaatactcataaggccatcatagatagaatctttaccaatgctagaaataattgaaaacagaagcatgcaattgaccactttctggtttctttgattactccaagctgtttgaagagctgatttctggaaagcatttgaaaactgggcataccaaccctaaccatctaattgccaatgaagaagaatgaattattctgcaattctattaaaggtgaaagaggtcccagggaacaattctaacaaaaattgtattgacttgggataaaagcttgactggtgacagcccagactattacaatattgagcctgagttcaaagagagtataagagcaactttatgtttggccacctttagacaaggttaccaccctctaccaagtatatgccaacttattcagatacggcattccatttcatatatgctgtcctttccttacccaccaaagaaaaaaaaatgctaccatatttgtttaccctgacatttacctggctgtgttaagttttgcattcaagtcattattttggccattgtctagtgtcagataaatttatgatggagcagcatcgatggaaccactcttctgaagttgtgggcggttggttaccttatggaactcattaacactagaattggatacagcctgaaaatagaggcagattgcaagcagattttgacaattcttggataacagatcttaatgggttatcaagaagaaaaaaagttcaacgattgcctattgaacctctattagcgttgtcacataggaaacaagacatcctcttaaatttgagtttcaggtaaacaatgggtaatatttagtaaaataaggtcccaaggtaataaggtcttagtataaaaaggtcccagtgagtatatggggcatacttctactaaagaaaggtactgtttgtctgaaacttgaatctaactggtaactggcttgcttgtctgcttgcttgcttgcttgtctgtttttgctaaatcttgcaactccagtctctgctgctataaaatcctatctcacatggggttagtttcttaattggtgagtaaggcaaaaattgcctatcttaaaaaattatcatgtgaaatcttttaaatcactcaaaatcaagtctacttgattttatatcattgtgctattatatctctcagtgattccaaaacaaattatcttacttgagtgttgaaaaacttctcagctgaacaccagataaagtttttaaattgtatattaaaataagctgtataaaatgctgtattaaaaacatacattggccgggctcagtggctcacgcctgtaatcccaacaatttgggaggccaagatgagcggatcacaaggtcaggagtccgaggccagcctggacaagtgaccagcctggccaacacggtgaaaccccatctctactaaaaatacaaaattagccaggtgtggtggagggcgcctgtaatctcaactactcaggaggctgaggaaggagaattgcttgaacctgggaggcagaagttgcagtgagccgagatgatgccatggcactccagcctgggtgacagagtgagactccgtctaaaaaaaaaaaaaaaaaatacattgtctgtttcttagattaatgtttatcagactaatgtagcactttgtttcaaatactaaatagcatacttaatgacttataatgaaaaatagcattcctctacccaacctctctggatacttcagtccaattctccataggcaacaagccctcaatccttctagctttttcccttaatatttactttcatatttattttaaaaaaactatgcctttttgctttttttctggtataatgaaaattttattgtttctatttggataattgattaaatgaaacactgtaacattttcctaacactaaatggaaaattttcaattgctctatgaagttaaattacacttatgtcaatttttttttagatggtctcacagtctcactgtgttgcgcaggcttcagtgctatcatgacccactacagcctcaaccttctgggttcaagtgatcctcccacctcagcctcccgagtagctgggacttcaggcatgcaccactacacccacctaatttttatatttttggtagagactggttttactatgttgcccaggttggtctcaaattcctgagctcaaggaatctgtccacctcagcatcctaaagtgctgggattacaggtgtgagccaccatgaccagccaactccttttttctgtggagtacagtatgatatttcaatacacgtatgcaatgtacaatgatcaaatcagagtaatcagcatatccaaaacgtcaaacatttataatttctttgtgttgagaacactgaaagtccattcttctagctatttgaaaatatgcagtaagttatcgtttatcatagtcaccctccagggctatagaacactagaacttatttctcctgtctacctgtacttttgtacccattaaccaatccgtgtactattgtttcttaacttagcaatttcacacattatctatacattttatattacttttgaatcaatctgtatactgtcaccataacttcttccttgggcaatccttcatttttcctggaggcaatcattgtctcagagttgtcttttttttttaatttgtctgattttctaagcccaaattgctagtattttccaaatgccccaacacctctgccttctcacctatgaataatgttttccatttacttagacacatcagttccactattttctatcccaaagacctccctcccagaacttcacatccatttcctctactctggacctgtctttccgtgcctgctgtccaggtcacattctgggtcctgtcctttgcagttctcctgtcttgaagtgtctgtttctgaattccatgtttgcttttgttgtctttgttgaccccattattaaaccacaccctccagaatcttcctaaggaaggctgccctaaaagcaaatattttgaatcctcacaagtatgacaacaccatttgtctattctaagttgataggctgagtagaattttagcttgaagattcttttcactcaaaattgtgttgctctattgcttccagttttctggattgctgctgatgagaaatgactcctgataacccatacgtgactcccaataccacatgacttattttcttctcttaaagcttgcagaactggctcttcaattttggggttctgaaacctcatgatgatgtgctttcatgcaggtctgatctcatccatcgcactaggtgcttatattcatttcctagggctgctgttacaaagaaccaccagctgagtggcttaaagcaacagacatgtattctattaaagttctggaagctggatgtccaaaatcaagatgtcaacacgcctggctccttctggaggctctgagggagtatctgttccctgcctctctccaagggttgatggttgctagcaatgcttgccattccttggctaaattcgcattatcactccagtttctatttgtatgaggacttcttccctgtgcgtctcctctatttctttgtatggccttcttataaggacaccagtcactggatatgggccccatgccaatccagtgtgacctcattttagcttcactgattacatctgctacttatttggaaaaactatatttccaaataagatcaaggcgtggaaaaactcaaactgtcttatcttcttctctcacaccaccaacaaccaccaacacagaatacctctgtgaccaaatgagtgggagtttttccttactcaccaagcagcaggcaccagctgagtgtcccctaatttaattctgacaccctctacctggagatagagtaagatcccacaggttgagggctgtccctcaagactgcctccctcctcccccagaccccagtggcaagtccaggcttctggaacttttcaccaactgctccaagttggggttcccatgcttccctctttgggtttgattaatttgctagagtgattcacagaatgcagggaaacacttacatttactggtttcttataaaggatattacaaaggatacagatgaagagatgcgtaaggtgaggtatgggaaggggtatggaccttccatgccctcccttggtgagccatcctccagtagcctccatgatgtccagctatctggaagctctgcaaaccctgtccttttgggtttttatggaggcttcatcacatatgcatgattaattaaaccagtggccattggtaatcaacttgcacttcagaccctctcccctccctgaaggttaggggtggggctgaaagtcccagccctctaatcctgccttgatctttcttgtgatctgccccatcctgaagctacccttggatggccagccaccagtcaatcagtagcatataaacagacatcattttggtaattctaagaattttagcagttttatgccagaaaacggggttgaagaccaaatatatatttcacagtatcacaatcacattctgaagttacaggtcaacataaattttggggggacaccattcaacctgagacaggaataatacaggatggtcacagaatagaaaattccaggggcagtttcacatgactagcaaaaggaaactgttgaaatagctgcagaacctaggggctaagaccctaaaatacagagtgtggaccaagctggctaagaccaactggactcaacatggcactgaatttgtcctaggtttcacctagaacctcattatacgctcattaacatactaaacatatacccaccagcaccatgacagttccaggaatacccatatttggtgtaaaaatgggtggcatcagttttgagaaatctccacctttttccaggaatcttcgtgaatattccaccctttggttaaaaaaagtccataaaggtgaaatcccataccctcttgtatgtctcttatgtgattctctcttgagtatgcccacactccccattttttttgttgtttgttttgttttgttttgatacaaggtctcgctctgttgcccacactggagtgcagtggcaggaacacggcttgagtatgtatttttcactttgcaataaatgtctgtactttcaatatttttttactcatccttgaattccttcttgtgatggggtcaagagcatggacactggctggcatcaaggtcccactggcgtttgggaccatatcaaagccactgtagtgttcatgagttcctttcattctggaactcacctccttcacttccagacatttttcttgattaattgatgttttcctttcctctctttcctctagttttgctccctgaaatttctgtaacttgcatcccgaacctcctggaattatcgtctaattttcctatccttgctctcttgtccatttctttttgttatgcccatctatggaactttacatttcagctttagtttccatttcatttcagctttttaatttccaaaagtcttttctttttctcagatttctcccttttttatagcctcttgttctcatgtcatggatgcagtatcttgtaatatctctgaggaaattaattactggttgttgttgctgctgctactgctgttatgtttttcttttcaaagttttcttgggttcttactttgtttctgtttcttccaggaagatagaaatgtctctgtctttcaagttgaaggctttcctcaaacgtgttgatcttttgatgtccttactaaaaagtgcaatactaaaaaatcacattagaagctctgtatgaatgggagagtttcacttcagtgtgctgatacaataacctaattctcacattcagtttctccagaaaaggaacacctggtctcagccagtcagagtgccccacacctgtaatcccagccctttaagaggtcaaggaaggaggatcacttgaggccaggagttcaaaaccagcctgggcaacatagtgagactccatctctaaaaaataaaaataaaaacaaaattagcagggtatggtggtgcacacctgtagtcccatcttctcaggaggctgaggtgggagaatttcttgagcctaggaagtcaagacaccactgtattccagcctgagcaagagagtaagaccctgtctctaaaataaaaaaataaaagaaacagctagtctctcatcaagttggatagagagagtggatagaggagagtatactggtgaagcagaatggacagggaatctgggcttttattgctccattttttttttcaaatagtctctctgtgtgttcaaccccattcattacccctgccctaagtagtgatgtgttagatgaatacagaataaaaaaggaaagttagtattttttagggcttaaagtataccaggtattttcgctgacttttaaaaattttatttcttatatttgagggctgcaatcaaacaaatcttctcctcaaatattgccatttgagtggataagaacgattttaaaagtgtcttaccttatatatgatgtggaaaggaagagatggcatttgttggtaacttgtcaaagctgtgtgggagaattgtggaacaggtgtgggatgaggctgcagtagtaagtggagttgagaaatccctatgtggtgaggcatgcaatgccagttgggaaacaatattggtctcagactatagctaaaggcaattcacggggtgagaaggacggagccaacatgctcagaacacttgtggttaagagcatagcacttggtttgccaggagtctgggtgtgagtccatgtcttctcaccaactcacgctcccattcctatccattctgaattctccattactgctccgaatcgccttcctgcttgtgcttttctgaagagtgtcaggcctcactggacaccaccccagtgccttcactccacatcacaacccagacaaaggatagtatatgcgttcctctacagatggcttagaaaagagtgaacgggcagagggcagaggaggggaagtgtacccacagcactttacagagattggctgaagattggattttggccatccatggttttttagttgtcctattgggtttttttgttttggtttggtttggttttgagacagggtctcgctgtgtcacccagactggagtgcaggggcgcgatctcggctcaccacaacttccgcctcccaggttcaagtgattctcctgcctcagcctcctgggtaactgggattacaggcatctgccaccacacctagctaatttattttatcattattattattattttggtatttttttagtagagacagggttttaccatgttggtcaggttggtctcaaactcccaacctcaagtgatccacacaccccagcctcccaaagtgctgggattacaggtataagccattgcacccggccaaaattcagttatctttgtttccattttctaccttaagaattgtacagagaccatcattttactgataaatatattttgataaacaaatccagaaacaagtgttgccatcccttaaaaagacagatgtgactgcacatttttttagtacagtttgtcttttctcacatctacacatagtttggacacatttttataaatatatatgtatgtatgcacatacacatacttcatatatgtatttatatatgatgtgctatatatattatatatgtatagatatatattacatctacagtcatgtgttacttaacaatggggagtcattctaagaaatgcatagttagacaattttgtccttgtgtgaacatcagattgcacttacacaaacccagatgggctagcctactacacacccaggctgtatggtatagtctatcgctcctaggctataaatctctacagcatgttactgtactgcatactgtaggcaactgtaacacaataagtaacacaattatgcattatgtatatctaaatggtacagtacatattgtagaaaagatttaaaatggtccacctgtatagggcacttaccatgaatggagcttgcaggactggaagttgttctggctgagtcagtgagtgagccgtgagcaaatgtgaaggcctaggacatgactgtacactactgtaagcttcattagcactatacgcttaggctacattaaaggtataaaaaaattctttctttaataaattaaccttagcttacaataactttttaactttatacacattttttaactttttgactcttttgtaataacacttagcttaaaacaaactttttgtacaattgtacaaaaatattttttctttatatccttattctataagcttttttctatttttaaaactttttttaggccgggcgcagtcgctcacgcccataatcccagcactttgggaggccgaggcgggcggatcacgaggtcaggagatggacaccatcctggctaacacggtgaaaccccgtctgtactaaaaatacaaaaaaatcagccgggcgtggtggcgggcgcctgtagtcccagctactcgggaggctgaggcaggagaatggcgtgaacccgggaggcgcagcttgcagtgagccgagattgcgccactgcactccagcctgggcgacagagcgagactccgtctcaaaaaaacaaaacaaaacaaaacaaaactttttttttatttttactttctagcctttgttgttgttgttgttgttaaaaacaaagacatacacacacacattagcctaggcctacaaagggtcaggatcatcaatatcactgtcttccacctccacatcttatcccacgggaatgtcttcgggggcaatcagacgcatggagctgttgactcctatgatgacaatgcctttttctgaatactgcctgaaggatccacttgaggctgtttcacagttaactttttttttagtaagtaggagtacgctctaaagtaatgataaaaagtagagtaaatgcataaaccagtaacatagtcatttattttatgtactgtaaataattgtatgtgctagacttttatactactggcagcacagtaggtttgtttataccagcatcaccacaaacacgtcagtaatgcattgtgctgtgacattaagacagctacaaagtcactagatgtcgggaatttttcagctccattataatcttgtgggatcactgttgtacatgtggttcattgttgactgaaacacctttatgcagtgcatgactgtacacatgtgtgtgtgctcgtgtgtatcataaatttacacagatatatagagaagagaaagtggagtttggaatggtatctaccaaaactcttaataaaggttatagtaattttctctggaaagggctgttagagaggatgtccttttcacagaaatacatcactcaaataatgagaaaataaaagcaaaactatttccgtttaggaaaaaaaaggcaaattgaatatatgtgagatgagtagtgaacataaaacatcgaagtagaaccacagataatttaaaagggaaggaaaaaagacatttataatagagagtgaaggaaaaaatcatactcttaaaaaactcactaaacagaagataacacagcttatgtaacattctcataacaacaaaactgaggtcctaggtgtacttcctggagcatgttaaaaatacagctacaggttaatgaaaaggctgagtgaaggaagttaactttaagacttgcaaaatctgcgcaacctggaattgcattcctattaaggaagtgggtagctcacacttcccctcccaatgtacctcttcatggatatttctgaccactttcattctgataacatgttaaaatagccaatttggccaaatttacaaaaataaatgtggctatgtatgcaatcccacatccagtatagatgacagcgaagcccagatctctctgtcgtagttcccatatgttcacctcatctcccgttagcgttctgaaatggatggcatcattggaaaatagtacaggtcccaagaagtagaaaatcatctccaagttagaaaaaaaaaaaaagactgagctataaatcacataaaagatggaagaattccctaatgtcttagcttttttcttactttctagtcaggaaaagttacttttacaggaaaaaattattaaagtttttaagcttttaaaagttgatgagtcaacaatgacagattaggttatttggactaactcttccactaaaaacaactaaaactgacgtagtaaacatttttagtccttttaacagcatcaaagagctggcaaaatgaaaaaggaaataccaagtaccaaaataaaagatgtaaatggaaaactttgtagttgctttaggtctgaagccatttgccaatttggaaggaactaagctgtccttttaatggacttgtggtatggaggaagcaataactaaaggatgaggcccattcaatgtcgtgtgtctagtaaatcacctccatctataataccccgagctctcaaaggtatacagtattggggaacggataaatcaatatatctacctatctccttccacccgggtagattgcagggagagataccttggactaagaagagctggagaagagaaataaagaggaaggaaggaaagaaagagaaaacatagacaaattgtccctgagaggaggcgaagcatgggcactttctctctaggatttacatcaccaattttgcagcacctaagtgatccaagaagtataaactatgattttaacttaaatagttattcagtcattgggaaataccccatatagagttgtttaagggaaataaacacttcacaaagacagcaaagtacttaaggaaataatacgccatgggtgaaaaccagcagaaataatggacacctaaggatttcagatattgcaattattagacataaattattaaaaattatgttctatgtttaaagaaataaaagacaaacttagaaataaatgcagggtataggaaactaaacaaaatatcatagcagatttgaagaagaacatgattgaacttccacaaataaaatatacaataaccaaaatttaaaacttaaggtatagtattggtccacagatcagatgaaaaagaactaagtaaactgaaagagagaatagaagacatttatccagaatgcagcacacagagcacataattgaaaagaaaaaaggctcaggaacaagaatataaggaggggaagtaagaagagaggggaagagaaaacctaatatacattttttaaaaccttttttaagtgatataaaagaaaatgaggtggtggctcacacctataatcctagcactttgggaggctgaagcaggcagattgcctgagctcaggagtttgagactagcctggacaacatgatgaaaccctgtctctatgaagaaatacaaaaattagccaggcatggtggtgcatgcctgtagtcccagctactcaggaggctaaggtaggagaatcatctgagcccaggagaggttgaggctgtagtgagttgtgatcatgccactgaactccagcctgtgtgacagagagagacaggaaggaaagaaagaaagaaagaaaagaaagaaagaaagaaagaaagaaagaaagaaagaaagaaagaaagaaagagagagagagagagagagagagagagagagagagaaagaaagaaagaaagaaagaaagaaagaaagaaagaaagaaagaaagaaagaaagagaggaaggaaggaaggaaggaaggaaggaagaaagaaagaaagaaagaaagaaagaaagaaagaaagaaagaaagaaagagaaaggaaaggaaaagaaagaagagagacagagattgagagagagagagagagagaaggaaggagacaatatttgaagcattaatgaagagagaattttctagaactggtgaaagatgtcagtccacagattcaagaagctaaatgacttccaaacagggcatttaaaaaaaaaatcttaacctaaatataccagagtaaaatcgcaggaaactaaagtttagaaaagtttaaaagcaaaaagatttttttggagaaaaaaacacagcagttgactgatagctgacttcttaacagaagacaatagatgggtggagttgtattgtcaatttactgaagacaaataacagccaactaagaatcctctacccacctccaccaaatcattcaagaacaaaagtgaagacatttttagacaaaaactaagactgcctacaaaaatctaattctaaaagataaactttaggcaaaagaaaagtgacttcagatggaagaagtattagcaagaagcaatggagagcaaagaacatgtaacaaacaaagactgaagcatcttttcttggaaagtttgtaaacacatttaaaagtcttgaaataaactaaaagcaacagcaaaactttaacttcaagcagaaagacttcagtagtcaatatggggcttccaaacatgggtgaaataatttttaaaatgtgtttttaaaggtttgcaggggaagaaaggcaggattaaaatcatcatttttgagacttagctgtctcgttgacatttgtgttttcttaaattttcttaatgggtgtattttccttttactgataacattagccttccattggaatatgttgcattcattgttttaataatgatttcaagagaaaagttataaatgaagaaagatgcacagactgttttctgcaatacgtcatgttcccttgaagattaattgtttagattccaagtctgaacttttatatacataaatcaagttctagcttaacattgccccaaattaaatgcatagcccttaccatgtcctagaaggatatatctggttcctgcctttgggtacactgtctcccaacaaccctccctcttcctcactgtccagatctacggcctgttgctcaagtatcccaagcctgtaattgcttgaggacctttgcacagtttttgttttgttttcacagccaggaatgctcttctggttctttctatggttggcttttcctcatctttcagtcctcattttaatggtgtctcctcagaaagcctttcctgactatcctctctaaagcagcctccctctcaggtcattatactactgtgctgctcatttccttggcacactcatcattctctccaattgtcatcttcacttgtttactagagtcttgcctgtctctttcccacagaaaataagttcagcttcatgaacaaaggacctttcctgagttgtgtggcattgtacctttaggtcctagcactgtgcctgactcaacataagtgtgcaacaaatatttgttgaatatccttaaaactgaagacattctcatattactgacattactgtctgacttcaggtgtgagccgcctgttctggattgggacttaaagagacacctgtaaaaggagcatcgaattcagtagctacgatgagaaaagcagatgtgatcagcagacatttcctgggagcttactgtgctaagcatcagagtttttttaaaatatgttatcatatatgaaagatatatataagatttcctgtaagaataaagttttataaggactttgtaaggtcaagatgggcctgagttctaattttattcttctacttccttgctgtgcaaatttagataacttaagtaaactctctcagactcattttccctatttgtgaaatgaggacaatagaaatgacctcatagggctgtgagaatcaaaagagataatgcccgtaaagcaatggctatgtgtgtggcatatcatagaagctctgtaaatgtaaatattcttgcctcattccatgaaataatgtttgatgcactctgctagagaaacttataaataatatttaattcacacttattttgaatctatataacctcccaaaccagtgaagtactaacatttttttttgacatggttatctaacaatccatggagagcattgccctaccaaaatccataccccactcttccaaaagaaccccaaatttatttgtggtagtaatgtgctgagctaatgctttagctcccagaccctcagaagctagaggtgtccatgtggcatgaacctggccaatgacatacataagtggcaccctcacatgagacttcctgcaagctcctttggccttttgaccttccatctccttcctgcctggaatgtgaacacaactcctggatgtacaacaaccatcctgagagcatgagaacaaagccacacaaaaaggtatggaaggaaggtagagggagtcagagtccttgatgctatcactgtactgccatgtccagccctgtactgcctagtcctggattacttctcatgtgacaaatagccatcttattcatttaagtttacttgattttttttgttacaagttagggttttgttacaagttgggattctccagaaaagcagaaccaaaagagatagagatagagatggggataaatacagatacagatatatacaaagagatttgttataaggaatgtacttacatgattacagaagttgagatgttccaacatctgcattcagtaaagtggagatccaagagaaccaatggtataagttaagtccaagtccaaaggtctgagaaccaaaacagccaatgttataagttccagtctggaagccagtaggctcagacccaagaagagttgaggtcttagctggagtccaaaggcaggaaaagaccagtgttccaagctccaacagtggggcagaggagtctcccctgactcctgggtgggtcagccattgcggtgtatttagtccttcaactgactggatgaggtccacttacattagggaggcaatctgctttactcagtctaccaattcaaatgtcaatctcatccaaaagcacaccctcacagactcactgggaacaatattcaaccaaatacctagcactccatggcttagtcaagttgatacataaaattaaccatcatacctgcagccagaaacaatgctgtgatgtaccagtccagaccacctcatgggcacctgcaaaagaaaatccaagggttcttttaagaactcactttttagttatgtgttctctcctcttcccattttatgtttagaaagcccacaggaagtggaacgtgaacataatcataaaggaagttaagaatcatgaaggaaatcaggctatggtagcttaaaatgtgtctaacccccaaagaacagctattgcaaaaatcttgagaataggtagagagagcactgccatccccttccccaatgagtccctttataattgttcccaaaggaactttgaaatctccagtgttgaacccagagagtgagacatgagccacaggttcccctgctggccccaagagaaacaaaacgaagtgtctcatcagcattacaaaagcttttacaatgtaaaattcaacattatttttgatcattttctctgatacttttgaatttgtgtataatgagcacgtaaagcacacccttattaatacactaaaagtggttttatgagcccaaaggaaaggtcctaatttacatgtgatgcttgctcactcattcatttacttgttggataaattactgaatgcttcctaagtgtcaggctctggggacacaaagccaggcactttgtaaagaggtttaaagagccaactctatcctctaagagttagtaatctaatattgacactgatacacatgcaaatacatcctggcacagaataaaagaatgaatcctggacattcttgaaccatgaagtacctatgtcacatacaaattagttcacatggaagttaatgtttacaaataagagtaattggaaatggaatgaaatgtatgcgtatgcatacttccatttccagtctagctgagcagccttgagtaagttacaaagcgtctgtgagccccattctcctcatgaagaaaacgagggtaataatatccaacaatgaaggagtctttgataattaaaaagctagtaaagcatatagtacagtgcccagcacagagcaagtggaaaatgctatttacagctacttctacagtgatgatgattgctcaaacattgattccactaataaagggtttgcacattacaggtatttttttttaacttttattttagattcgggggtacatgtgaaggtttgttacataggtaaactcatgtcataagggtttattgtaccaattatttcatcacccaggaattaagcccagtacccaacagttatcttttctgctcctctccctcctcccaccctccaccatcaagtaggctccagtgtctgttgtttccttctttgtgtccataagttcttatcatttagctcccacttataagtgagaacatgctgtacttggttttctgttcctgcatttctttgctgaggattatggcctccagctccatccatgttcctgcaaaagagatgatctcattcatttttagggctgcatagcattccatggtgtttatgtaccatattttctttatctgatctgtcactgatgtgcacttaggttgattccatgtctttgctaatgtgagtagtgctgcaatgaacattcacgtgtatgtgtctttatggtagaatgatttattcctctgggtataaatggtaatggcattgctgggtcaaatggttgttctgcttttagctctttgaggaatcaccatactgctttccaccacggttgactggtatttttaattgatcaggtttatccttttcctaccaaaaagtcagggtcccaaaactgtccctaatgactcagttctcattaagacaaagtgttttgtttaagtaaataagtagggggactggaggtataaaaagaaaccaaattaagtgattacttgaatgcttttgccattgtggatttagccacatctgtttcatgttatctactgtggtctgctaaaattcctgtcatctcatttctctttaaatgaacaattctttattgctgaaatgtattttctagatccttcttttaatgtactcatatttctgtttaacacactatttatttgttcattcattcattaaaagtatttttcagcacctactaagaaccaagcacggttctgagtttagcattgttaaataataccaacaaggtagacaggttcctgatcccaagtatcttagtcaagcctatgttccaccaacagtccaaaatgtctttctagatcctttcatatcatgtactttctggtcaattcttataacatttcatcccttaaagatggttcatatcatctttacctataaaatttctgtctttatttatggaatatgattcattaagattattttatttcacttctgttctctaattcatggtttctcaagttagtgggtcccctaacaaaccctctacaacataaaccacaattgacgtttaattttggtggttgaaaaacagttcgtgtcaaggtttgatttaaaaataagtcatcctctgacacaaattacattcctaatgtaatgtgatggacacattaaaagaaggctttccagtaaattccttagagtttccgtcagctcagcatacaggagagattgaatatctgctcaaagcatatgtttatcagggacatatgcactaacacgtgagttattttttcaaacaagattttaaaatccaagtatttttatgttacaagacattaaaggcactgatcattcaccatatgaattacagccgtgtactgtatggggaaccagtgggtaattctttgcacatcaaaagatgttgtctctaaacgtaccaccctccctctcggtgttaatgctggccttggctgatccctcatgaaagactagtataatgtctttttaaatgacttttttttttgacttatgtaacattcacaaactaggtattcaggaaaaaaaaaaaaaccttagcaagtttttgggaagagatgaaagcatgttctgttttaaatgttcatctaatccttcatagagggataaaataaacacgttttcaaaagttcagcaaaatttttcagaagttcaacaaaaaattcctggaaagctaagaagtgtcagttcctttcagcccagcagcactgtcccagacaatgtttaacacaggtggcacaaggccagtagtaatgtcctttctgaatcatttaatttttacccaggaagtaattcatctagcaagctcttgcctctttaatcacccaccagcccctacctggccctatcatgatgataaaatgcattgctggcatcctactatcagccaacagataggagcacccctgggtgctcactggtttgaaaactctgtgcctttcatactgcctgtctcttatgtttgtctgtccatattcccaacaatctgactgtcttagttcattcagacagccataacaaaatgccttagaccggatcatttataaacaatagaaatgtactgctcacagttctggaggctggaaattccaagatcaagataacagcagattctgtgtctggtgagggccccattcctcacagatggtgccttctagctgtatctttatatggcggagggggcaaacaagctccatccggcctcttttataagggcactaatttcattcatgagggctccaccctcatgacctaatcacctcccaaagacaccatctctcaatactactgcattggggattaaggtattaacttatgaactttgggggaacacaaacatttagatcatagcactgattgattgaatctctgtctctgtctatttctatgactgtttcttcctttccctttaactccacttctctgtcactatgtgagtttccctctgcctctatgtttgcatatctctgtctctgtggtcctgtctgtatgtatttctctctgctcttctctgtttcccttcatctccctttctcttctcacctctctctctcactgactctctctctctcacacacacacacagccacgcacacaaacacacacacacacatgcatgtgcacacaaacacataagggcattgttgtcttatctttatcatcaaccccaaatagactgttacatgtctcccacactattacaataaaacttctgtctgaaaaacaagtttctatgtagagaaattttgaacattattagaaaacaaaattccaataccagcacaaagaagttctttatagtcctctacatccagaatttgacatgagaacttcaaacatataataaaatctgtcacatagaccattggtccaaaatagccctggaaagattctcaaatccgtaggacatctatcactgggtactaactgagtcagttatacaccttatatgtggatttactataattttcaaagatatgttattcaaggtttctcagtgtcagatttgtggaggtccacaatgggtgatttcagggggctcatgaacctcttaaaactgtatgtagttttctgtatatgagcatttttcaagagaaaagtccacagctcccaccaagattcacaaagtactaataataagattcaccaaaatactaataataatcagccatgtgattgtcatcttcaaaaaattataaattcattgtaaagattttacttttggtcaatatataccttatcgaccaagggatgctaatagtcacacaccaccatcatcatatggaagttcaaaaagtatttgacaattaaaacagggctaatcacagtattaaaggcttataaattccacctacagggaactgtttatttggcactgcagttgttttttaatcttttttatatttgagaacaatttctgacataattcaaatgcaccccatctccatgcatttttaccttcctgaatatttccattagaatctttaattttctaacatagctgtttaaatagacactgagaagagaggataaagtcatgatgcatttagcaagtagctcattctattctctacaattagtcccactgaggagttgagttagataaaagttgggaaggttacctattatcttgcttctcaatgctttcatttgtgtgtactgcttcaacaactccccaaataatgaaactatagaaaatggtcaaggttaattcgatgcagatactgcactttaaatacaattatcatttcgtttctaaaacgctttttaaaagaaatgattgcttaggaaatgagtgagcagagaatggaaatgaaaactgtatttcttagcaagcatgtgggcttcaggaagcaacaggaggccaaggttggaagagtacattcataggttccacaatgccaaagggtaaagctctcaaactggccttcaaggttcttctgcaggatggagccccaatctttagatccatccttatatctaatgttcctcaacagccaatttatcccttctcttcctccttgaacccaatattctaataacccttcatgcctgtgccatgtggcagacaaacttcaaggtggccaccataacccccaacacctggtgctcacctttctctcgtcctgtccctttgcatgtgtgctcctaacaaatagaatgtggtaaaggtcatgagatgttactcccgtgattatgttatgctataaactctgtatggttagcagatccattttggagtctctctctctctttctcattcacttttccgtctgctttaacaagctgccacaaaccctgcagccacatgggaatgaattctgccaataatttaagggaacttggaagtggatccttttccagtcacatctctggtgagaacccagccatggccaacaccctgactgcaaacttgtaagaggctgagtagagaacccaggttcctgccctatagaaattgtgagataattaatgtatattgcttgaagctgccaagtttattacacagacaaggaaacaaattaagctagtgctgtgctgtccttctagaatgctcttcttctttggaaatcctgcccctttttcaagaatcagatctgaaatctctctttcacctttttctcacctaaaacctgacaatttatccaaggacctcccaagcagtttgattttcagcctcttttcaacaccgttttcccacatggatgactctgggccttaatgtctcacatggtactacatattccacagggatcatcatgaattcacatatatgctcagtactccactctctctgcctgatcgtttcctcatgatcttttgatggtgcttccctgggcctatcacacctccttttccaccactcaacccttctcctctctctacaacaaaagcaatctctagcaacattccaaatttcagtgacacccccagatttagacttgtgacccagtttcttcttggctttgaatccatgctaattttccccagccaaccaaaccctctctcacatgcttaaatggaggcatgagggtttaattaggaatcttcctgttagtcagcctctccagtcacctcaacaaggccctcgctgttggctcactggagcaaacagctgtgagactggtctctcaccagctacctggctgccacttaaaatatttcatgctcagaggcacaaaaaataagctcaggtctgagtccatatgcagatcatgacaggcctacctcacttcactccacatgaacctgtacacatcagatgagtgcaatgcccacaaaatagtacctggtatgtattaggatgggtaagaatttaaactgggaaagcctttttggagggcaatttggagtacctatcaaaatataggcgtttgtatagggtgatactcagcagttcaaaagaatgctaggacttttgcttgcgagaagagagattagacacactttttcctatttttcctgtttagtataactaaaagctccggacattgtatataacacaaatgtaagtaaattctgaagggaggaacgaagaaggcaaaccagctagggatctgtgatcaaaggaatgacacggtgagaaatgccctgggttttctttttggccttatttaataacccaagatttggagctgaagatgctgacaacccaatctccacattaatgtttgtaacagtcctaatggtcaaaacctggaaacaaccaagatattcttcaatgggtaaaaaggttaaacaaaccatagtacatctgtgctatggaatactactcagcaataaaaaggaagtaatgatacatgcgactacctaaatgaatccccagaaaattacactgattgaaaagggtcaataccaaaaggttaactactgtaatatgccatttatataaaatctttgaaatcactaagttatacaaatagaggacatagaggacatttagtagttgccagggtttgaggaggaattggggggtgggagggaagtaggtgtgccaatgaaaagaaaacaggagacatccttttggtgatggaaatgttctatatctttactgtatgatgtcagtattttggttgtgatattaatttagttttgcaagatgttaccattgtgtaacacttgtgaaagggtacaagggatctctgtgttttttttttttttttgtgggaactgccggtgaatctacagttattcaaaattaaaagtttagttttttttttaaaaaaaaaaggaatactatctctaagctctccaagatgtactgtttaaagaaaattaagttgtagaacattatttacagtatggccccttttatgtcaatattaactaacctttataggtacttacagtgtggcaggcactattccaagccctgtacacacattcattcatttaatcctccttataagtctatgaggcagtcactattattatctgcattctacagagaaggaaactgaggatctgagagtttcaataactcagtcaaggtcacttagcatatgacagagacaagacttgaactcaggcagtctgactccaggatttgtgctctcagccactaactgcatatttctactatccgtctgaaattaatttttacatgtaccttagtagaaaaggatcttaaaggatacacacaaccagtggcatccctgtaagcaagcttatttttttggaggggaagtggcctgtagtctttgccaatgtctatgatgcaaatatgctcaatttcaagctattaacatgctgtcactaaacacaagggttgctataagccagctccagcacatcactgtacattgtgtcatcgtgtgtgacacaacaaatcaaaattatggtgtcctcagaaggggaaaatgggaaattaaagagtttaaaatgtgattttttttactttgtattatttgtttacaatgaaaatatacacattactcacacattttaaaaatactaaaagaagtaaatatttaaaggtgtatcctactggctttgaccttaaaatcctttatggcacatctcctcccaacatattccagtgctcaaaatacttcagtgtacacattacctacaggaaaatctctcaggccccttctcaggacacacaaagcctctcaagggtttgtccttggcctgatcccaggctcaacgccttccataaacatctatgcctcagatgacctgccatgcattgtcacattaccattcctttggtcatgccattttctgttcttggaatgtctttttcatctcactctcatacttaatgctccacagctgatataaaacctcccactaggctatactgtccttgatgggaggagtcatttcttattcatctttttctcatttaatcctcaccaaacccctacatgagatgtatttgttaactattgctgcctaacaaattacttccaaagttagcagcttaatgatatttactgtttatgtttctatgggtcagaaatctgggtgcaaatgaatctctgctttacattgtctcacaaagctacaagacagggtcactggggctgcagtctcatctgaaagcttgactggggaagaatccacttccaagctcacccatatagttcttagcaggactagattccttgtaggctgttggcctaaagtcctcagttcttctgttggctggaagccaccctcatttccttgccatgtggactcctccatagagcagcccatcacatggcagctggattcatcagaagcagaaagcaagaagagtcagagagaaaaagtacaagcaatccagaagccacagtttttttaaaacctgttctgtttgtttgtttgttttagagacaagatcttgctctgtcatccaggctagagtgcagtggcacaatctcagctcactgcaacaactcctgggctcaagagatcctccggcctcagcatcccaaaataacctactcttgaaagtgctattccatcactttagccacattgtattcattacagaaaatcattaggtccaaccctctgtcaaggggaggggagtacacaagggcatggacatcaggaggcaggggtcattgggatttgttttagaagctgccgactccacaagactccacagctgctgaggggcaggacaaatatgcataacacttccagtatttctatactgctacacaacatctgcctgtgagcatgacctaaaattctctatttgccatatgcatcaggtttttttgttttgtattttgagacagaatctggctctgtcattcaggctggagtgcagtgactcgatcttggctgtcacttgactgtcacttggctgcaaactccgtctcctgggttcaactgattcttgtgcctcaacctcccaagtagctgggattacatgtgagcaccaccatgcctagctaacttttgtatttttagaagagatggagcttcaccatattgcccagacagttctcaaatttctggcctaagttatccacctgcctcagcctcccaaagcctccctagggctcccaaacgtggctcacattacaggtgtgagccaccggtcccgactagccatatgcattctttaaacaaataagtcttggatgcctataatgtgccaggtactgttctgggtgctgagggacagtaataatgaagcaaaagaagtcccatcatcatgagcttacatactaggtgaaggagacagacaacaaacaaacaaaccaaaaaattaaattacatcagttggtaaacagagtaagaattttaaaagatgttgggggggataatggtcaaagaaggcctctctgagtagagacatgaaggaaatgagggagcaagccaggaggaaatgtagggaaagagagtcaagcagagggaacagcaaaggcaaaggccctgcagtacgaccatgcctggtgtgctccgggaactgcaaggaggccagtgaggtgcaagggaagtcaacaagcaaaagagaaggtcagagagattggcaaggccttgaagctcataggaaggattttggtgttttaagtgtgtcaggaagttgccagagagtaaggaatttcttttcaagatccactcatgtagtgagagaccaaagtattatatttcatgagctctttctgactcttactgttgtcctgactttgtactgacagtttctcttccatctgtttcagaggatggaggatttacaaaatcgtcagcctgtggcgttcccacagggcaaggctcaccatcatgaacctagtctacttgtctccttgcaccaaagcctttgtcccttttctcctcttggattcatttgtgaggtcaatggcaagtttccaacaaaacagcaaaaaccttgttttgtttgtttgtttgtttgtttttctttttttgagagagggtcttgctctgccacccaggttggagtgcagtggcacgatcttggctaattgcaacctctgcctcctgggttcaggcaattctcctgcctcagcctactgagtagcggaaattccagacacgtgccaccacacccagctaatttttgtatttttagtaaagacaaggtttcaccacgttggccaggctggtctcaaactcctgtcctcaagtgatctgcccacctcggcctcccaaagtgctaggattacaggcatgggccaccatgcccggcctcctttttctttttctaagcaaacctcctgatttttctctgaacaaacaccatctagtttgacgcagaacacagaaacacagccaaaacaaagtccaaaccctggtaagacgaaaacaaagttgagccatccggagcacctgggtcagcaaatacttccacattctccagagtggacatacagggtgtcctcgtattttaaagatgcaaaatgtcaatatataagtttctgaaactatacttcttgcctcgtcccctccttcagattcaaaaaaaagtaaatccacaactctgatgcactatagggtagacatgaagctggatttctcaaccttggaacaattgacactaggggctggataattctctgttataggggctgtgccatgcactgtaggaagtttagcagcaatcctgacctctaatcactagatgcccgtagcatctttccagctgtgacagccaaaaatgtctccagacattgctgaatgtcccttgcagctcaaaattgacccagttgagaacaatttccataaaggctcaggtgcatgttcttgggcaagttactaatcctgtttggccctcagttgtttgcctagaaaacagagaatagacatgcctaagaacaggaagtctgagatctctgtccaagatccatgcttatgtgaatctgtgatactcagtgaaacaattacactacattgagagcctccaggtttgagcaacatgaaggcacaaattgaatcttacacagctctgtgtattgtctcgtctagtttgtgacatacagtaggttctcaataaatattggtttaattatgattaaatatcacgtgtatgggtcttctcacacttggcactattagatgtcccatatccagcacatagtaggtatttaataaaattttaatagtgttattaaatatggtgaggtcaccttaaaatcaggtcctttttaaattcagaaatgttcaagttaaccagcatttactgatcatttacaatgatccaagcactggggagaaggatatgaatgaaaatggctcttgtgctttagagaatcgtgatacagtggtacaagtcagccccgcatcacaggagactccactcgacaatgaaagatgttatagtcaggtaacagagggttccaagtttctgagaatcttttacttgcattggttctctggaaaaatgtactttggagaatccaatcccattaatataagcaattatattatatacaaatgaagtcattctctttgaatgcttcatgaaatgaatcacatctttcctcacctttctcactcgattacatgcataattaaatctagtgatggttttatcttgagtgccaacttagacacatagtggtttccaggagaactatgttaaggattctgaggccacattcaagcccattcttaatgtctgccatggatgcagcatgaagaaatgacttcacttccaagtatccatcatacctgatttaacctcttcttgataagtcaagattatattataattatggtccatcatatcaggaaatgacttcatcattctacttgcatggattcaaatcattggaatcatcctgaactcatcttttgttcttatacatcacaaccaaattgtcaacaagtgctaatggctctaccatcaacaaagactcacccccactgctgccaccctggcatgagttaacatcatgggtcatctcctcctattctttttactgccatactcctccaactgctattccttgaacctgccaggagccctccctactcaggacattttaactcactgttccctataacttgcatgctctttctttaccaggtaacctcaaggttgatccttcccttttgtatttcctcactgaggacttccctggccttcctatttacagttgcaactcccacatcctccccttctccctatcccttcttgctgacttgtacatattacttgggaccaactgacatcctatatattttgattatgtatttgtttagtggagacatcccttcaggaagctgcatgaaagcaaggatttctatccattctgttcactgttacatctccaccacctagaacagtgcaggctcatggtaattgcttaataaatatttaccaaataaaagaatggataaataagtgaattatcagagctataactcaatgagatttaggagttcttggagttttagaagcctgtttgtctctatactaaataacctcataccatggtgctgtggtcatttcactacagtcaatgaatctgtctagagctgcactgtccaacatgagagccactagccacatatggctatttggatttaaatttaatcaattaaaattaagtaaaataaaaattcagcccctcagttgtgctagccacatttcaagtgctcaatagacccatgtggctggccactactatattggacatttccatcactgcagaaagttctattggccagtactggtctgaaacatccactccggctaccctcaaagtaattaattttctaatttgagggaccaaccaaacaagcttgttaaaaccattcatagtaagagcaagctaaatatcagtcaaggcctgatgaattttcctaggagattctgtgcctgggctttctgacctatgctttatccttcaggatcttttatttcttggctttgatttttcactgatgttcctgatgaggtgttaggtagatggcctgcaaatagcaagctgctacagtatcacatcttccatgtaaaaaatgcctcctttactcagaaatctgttttgtcagtctttggagataaaggacatgtggcacaactgtcagaagtaaagacgggactggaataagatcctctttgtggctggggatcagaaaaggggtaagtggataggaaaataggaagtggaccgattatgaagataggcagacagaacattataactccagtggttgacattcacattgtgagagaaacaagtaagaggaacgtagggtacacttactatttacagctcaaggattctggaagactcaggaagaaaaggcatatgaatttgaatgatcatcatcagttttcatttcaatagatcatggggcccacgtcctggttcatcacagacatctcccatacatgttatctctaatcctctttaaataatacagccaagtcatttgcagaggtcaggatgggcaatgctccctgaaaaggagtgatatggtttggctgtgtccccacccaaatctcatctagaactgtagctccgacaattcccacttgtcgtgggagagacccagtgggaggtaattgaatcacagggatgagtctttcctgtgctcttcttgtgataatgaataagtctcataagatctgatggttttaaaagggggagtttccctgcacaaattctctcttgcccgacaccacgtaagaagtccctttgctcttccttcatctgctgccatgattgtgagacctccccagccatgtggaactgttagtccactaaacctccttcctttgtaaattatccagtctcaagtatgtctttattagcagcgtgagaatggactaacacaaggagatattttccctagcctgtgttccactctctgctctccagaggacaaatgaatctatcactgctgagagaagtccacactgcaacacttgtaactgtcatcttcaggaacaaacaaagtctttctccctcttcttgtttaattacaaactgctttcagatccatgaaggaactgtaaatacgtcctgattgacaacaagccttgagattgtgcaaggctaacatcagaggttgagttcaaatgagctaccgatacaatctgatctgattttaaacctgttaaacaaccaaaggaaaaagttaagtacacttctcaaaaaaataaaatctcaagatgacctttaatttgaaactaaattgttatttatttaaaaaacatgccgtgttttaccctcctctttttttccagttcaagacattcttttctcatgtcgcagtcaaatgttcctattgttttctgaaggtcatagtcttacatagtcttaacatggtgacttttcactatttaatgtttgtttcatgaataacatgattgtttcctaatttcgttccatgattagttggttctttccttatctatgcctcaattttctattttaataggcttgccagtgaatttttaaggattctgaataaatcttgttcatctttctgtgttccctatggtacttcatacagaatctgacaatgaattggggtgtatttgttgaattaatgaacaaagaaatgagtcgatgaatggatgtcagattaactaggtgaagaaatcatcacaagtgcctacggatggccagtctcagcatgggtgtcctcactcagatcctacagccagcagcacatttaccaatggagcttcattatcgtgcagaaaaaccctgcttgccctggttcgggagtaactggcggcagatgaaggatgggtactatgagaacactggaatgcaacacagcattcaaacaatcctaaggaccaaggcagatgccatgtccctgaattggttaaaaaacaaaaagtctctttggactttacccaactttcagacaatgagcatttgcaataagtagaacataccaggaaacaaagatgacctgggaatgctcccttttaagtcacatatcgacaattgataaccttgactaaaatggctctcagtcactccttcccatcgctttctaggtcacacagcgaaatgaagtccaagctctaacttagcaggccaccatgcaaatacaaacgtcacagtggccatgcttctgagcctttggaaaggtagacttgtggtaggggaagaactatggtttctggtgccagactcctggctctgccacgtactagccatgtgacccagccaaactactcgactcctctgtgcttgggttttctcatatgcaaaatgggggtaataattgtaactaccttatggggttagagtacagactgaacaagttgatatgttcagcattgtaatgtcaagcactgagaacagtgccaggcatgtagtaagccatcaaaaagtgactgacactacaatgatagtgatgatgatgaggatgatcttgggaaaactgtacctcagttatcgattcccattctgggacacagctcataatatagatgtctactgaacagacctggagtgtgtttataatccatatgtcccacggcacattatagagcaaccggttccactgtattttcacataaatattcacatgtgcgaagattctatatcacagatgttctgggctgtcaccacaaaagtaggaggtagcagaatatagtgcttatgactcagaatggcatgagctcaaaccccagctatatcacatattgtctatgcagtgtggacaaattaatcaaccttgctttgtttgctcttttacaaaattgagataaaaacagtgcctgttttcatagtgctgctgtgaagatgaaataaaatactccattatacttttaagtttgttgcaaggacttgttcaatagaagatagctatcacaatctatcctttaggttaaaatgcagaggtagaagattgatctgtttgagtccatcacaagactttgattcaaagaaacatggaccctctgagccagaaggggtcttcagaatcatttaccccaggctctttcctttacagttgagaaaacttcccttcgctggagaagggaagtcgcttacccaagcttacccagctgaagagaggtaaactgggattagaaagcagtcctgatttcctggcctgggactcttttaccaagactgcactgactccctgatagaattcagccctcttcattcccagactctattttctttaccttgtccaatgtgacagatgcttctagtgttcctgaaccattatcactcagctttcacctctcagctggtggcttctactactggcgggacatctcagagatatgttctgtgctgcctccctgggattcttccctagggactaagccggtttcccccagaggtagcctgctccctaacattcgttgtaatggcttccttcttttctctgtctcaattcttcatccccttcccagtgcttcctaggatcaccttccacatatactacttgcacgcaattccttgcctcacagcctgtttctggggaagtacaacctaagacacccacaaaatgaataaatgtttttaagagagaaaaaatggaggaataaaataacatgaaatagtataaaataaaagactttgggagagtatatagatgcagtccatgcgtcacaaaggggtgaatcagaagctacatgcgggtcattggtggctactcagactagatcaactcaagctcagctatcttcacatgtctgtcggtcagatattcagtcaatggcaaagtcaacatacttactcctcctgtggacaaccctgcaacacagcacaacacaacacaacacacaactctctttatcaacaactatacccacaactccaccatccataaaatattctgtctgttttgcttctcctaaaagtcttcctccttctatgtattcttcaaatagaaattcccaccttcagggaactcagttaactatttgccttccccaacacaccagtggggagggaaatctatcagactggttctgagctctaggtttagaagccaggcaagttgcttcaactccaggcttccatgtcactactaactaggaataagctatctggcctctgcaaacatcagtttcctcacctgtaaagtgcagtagtaatgcttgccctaataatgctgtgatgatttagtaatacaatgtctgtaatatacatactggcataagggaagagtttaacaagcaggagcagtaatagcagctgtgactgtattgttattgttgttctataaatgcctccctcattcccattgtcatggcctcctgcaactctttcctgggtgccaggctctctcagctaaagattgtacaagcaagccttcctcccctttcatcacaaaaaactcatttggagtctttctttgaaccactgagggagaagggaaatacagagtcctctgagaacacagatggcacactaaccttaagggaaaaggcgttgggaaccggaccaagggccatggaaaactcaagaaaaaagctattgtgatgaagttgaaagcttcttgcaaaaaatgatgcatggctttctgcttctagtttcaatttcactgtagtgttgctgaagatcttgaagaaattacgtcatttctcccgtctttgtattcagagcaaagcaaactcacagagggaattcaacagggagataaacagtgagatatccgtttcaaaatacgatcaccatggtgtctgaattcacctattttgcattaagaaaatgaaatattatttgcaatcctacataagcccatctaacagaataagcttcgtatagtgaaacaaactaacaggcaaacaacttctgattgttagggtgggctaactggcataaccaatacacgccaaacattcgaggtttatttcttgcttgtataacagtttggattatagggtgccaggggtacttcccatgcagtcatttggaggagccaagctggcagagcagctaccatcttcaagatgtaaattccatggtcgcttgggagttgtccccgtttgaaccagcaggaagaaaaaacagcccagaagaagtggggaaggctcatgggccagtgctgaagtggagttcatggcttccatggacagtgcattgactatcccagggtctcacagaactgaaacgaagaagaaaatatgactgttggtgtctagtcaacagtctcttccacagaagtccagattttgattcaagagccaggacttctagacctagctactaagtaactatgaaaaagcaactcaacatctgaatccaaaggaaaggcttgggctgcttgacaacatggatggggagtatatgaaagtctcctggatgaactgatcaaactccacagtgagatcccaggatgactccacagatgtgtgttactggctgggaatcaccagagttgggctcctggcctgggtggcaccatgtagcatcttaggtggctgaggtggaaattatctggcaataccagattcctttttttttgagacagagtctcactctgttgcccagcctcagtgcagtgacataatatcagctcactgcaacctctgcctctcgggttcaagcgattcttctgcctcagcctcccaagtagctgagattacaggtgtgcgctatcatacccggctaatttttatatttttagtagagatggggtttcaccatgttggccaggctggtctcgaactcctgacctcaagtgatctgcctgcatcagcctcccaaagtattggaatttcaggcatgagccaccgcgcccggcctggcaatagcagatttctaaggttactcccagctctaactttcaatgatgaaaactcatgcatctacaaacaatgcatgagaagatatcagtttctgtagaggagggtagaagctgtcatctgtgcttgtcaagcatgttcttgtatctcctagttacagaacacaaagatctcaagttgcactgcatgcaagcagaacctaggtaaggagagagggagatagattcctgctgatattatttgagatcctagattccaatgtggctgaaggcaacaaatattcaaacttcctctgagtgcactttgaattatcctcctaataaatccttctcaacctcaagacctgcctctgttccccccgctatgtcctcacactgctttgtgaatccctctgctataacatttggcttgtagaactggaatgacttgcttttctggctatcttccccataaattcacagcctctccagcacctaatacagtgacgtctgcccagaacctaatgcagtgctgggcatctagcaggcatacaggaaagtttttctgagtgggtttgtccattgaaagtttaaacaatgggccaggcatggtggcttgcacctgtaatcctagcactctgggaggccgaggcaggcagattgcctgagctcaggggttcgagaccaccctggcaacatggcaaaaccctgtctctacaaaaaaatattaaaaattagccgggcatggtggtgtgcacctgtagtcccagctactcgggaggcttaggcatgagaattgcttgaacctggcaagcagaggttgcagtgagtcaagatcgcaccactgcactccagcctgagtgacagagagagactctgaaaaaaaaaatttaaactattactgcagaacagcattgaattgtgaagcatatgggctgtagaatccgagctctactcctggcttttccacatacctaccacgtgatactggacaagtgaccctgcccctctaagtcttagttttctctttcatcacatggggatagatacacaagtttcttcacagaagctcttctgcattatgaagcttcttaaaggagttaaataaggtcacttttgttgagcacttaccacagtgcctttgaaagtcccgaaaaaaacattagctgctattactctcaccatcaccatcattattgtccattcatgctctctcaaaaggcatccaggtcctctgttaaaaagccattactgactgaaaattgcaaacgaggagaagctacccaggtttgaagaggcgatgctttaatagaggctaaacatcagcacaatgtcagactgttctgagcccctggagccaaggcatccatcaatctgaacatgaagaccaccacatgtacactgtaatgaagaggccagtggggtgggagatctgtctttaatcccttaactgtccaaacttgggcaaatcattacactccaaggcctcagtttcctcacctacaaaatgggcacaaaatgatcatatacacttcccagggttatatgggattataaatgagaaattgtgttgtcatgccactttacaaagctttaaaactcaatacaaacgtaagggcttttgtttttcaaagccagttgtaactgttcttcagccgatgcccagaagaaaaggctgggctgaggcaactcaaccttagccaggcccagagtgctcagagaatgaggctagaaactcagtcaattacccaaacaatttaccacaaacaaagccatgaggttgaggggatccaccaattagcacacccactagaaagacatctcggattccttaatgagtggcatctcagaggcccagggaagggaagtatatgagcccaggtcacagacataggtactgaaagaagcctgattagagtccacttgtgactgaatctatatggaaacataagcactaggctggggttttcacagagagtaacaagtcgtatttaagattttcactgtaatcccaacactttgggaggccgaggtgggaggatcaccagagcccaggagcctagacaagatggtgataccccgtctctacaaaaaatgtgaaaattagccaggcatggtggcatgtgcctatagtcccagctacttgggaggctgagatgggaggattgcttgagccccggagttccaggcttcattaagcgacgatggcaccactgtccagcctgggagacaaatactgtctccaaaaaaaaaaaaaagattttcagtaaaaaaaaaaatagctcttaataacagtccgtcactttagtaggtactattcatactctattctgaatccttccacaaactctaaaatggtagcgtaaatcccattttgtgggggaaatcgaagcccagagaggttcagtggccgacagtgggtcacgcagtgtttatgcatttgaatcgaagttgacccaacaccttacaaaagcttgaattatttccactctgtgacctcctgcctcatgttccatatatactacttccttgaaacattgattttcttagtcactttctcctgggcttggctaatttaaattttgcagccaacacaactgctgctcaaatgtgattcaaagagcttcagggcttctctcaagtagaagacctcagagggattatggagagggaacaaatgcagcttgtctcctaagaaagaagtaattcagcctaagtgaggctagaatcaggctagtctgcaggctactttcccagcaagagccaagggaggtcaaggttgacaggaaatcctaagtgagaaactgaagtgctcagctgcacactgcgagggttgccaagaaattaattcactgaggaacaggctttggagcagagaaaagtacaccacttttgataagggcaaaaaagcaagctgacagcaaaagtctgggaccttcttccaaggagagagtggcatccttcattttgcaaccctgggggtgtccagctgggggctccctctgacaaccagccatccttcatcaatttccatagtaatcatggctatttattcagcatgagaaatgagcagtcagttggtgaatgtggggaggagggagctagagaagcaggggtgaaatggaatagaaaaaaaaaatctatagaaacattcaaaggctgaagttaaaatgtccaatgttaaaatactgaaatgccaagtctttgaaaaataaaactggaagtaatctttaagttcagaaaagtcaagaaggcaaactaaatgactttttttttaagtgcatcacttttgcaagaacaaaggacactcacaattttacgttcccaaaagagagccaggaattcatgctgtctttaaattaggataatcatttcaaggcttcctcttattgccaagttggtgctgaaggagactggtaattttgtctcggaggggaaagctacagagaatgtgaggttatgcaagcaattaatccaatattgacagtggggtttgctgatagacagacagctcatgtgtgatcgggctccaggctgcctagcatttccacctcacttgtagccatatttgaattagaaagagaaatcagaggtgttcaagaaataagtatttggcggggaagtgggagtggtgagagtttctggattttaatgaaaatagaatttctacataggagggactggcaacagggcatggggaaagcatggaaaattggaagaagaaagctaggaaaattgtcttaaatttgaattctcataagcagcacaaacttttccttcaattgtatgtatatgtgcagtagcttaaaaggactgatagaaaacccgatggcttgtcttctccctagccttgtgtgatcttgagcaggttagctaacctctccaagcctcagagagctgtcagcatattttgaaggcccactatgtgctggatattggcctggatgctgaagaaccagtggcaaaccaggtagagcttctgccctcaggaagcttacattcgagtggggatgagagacaaaaaacagaaatatatgctcaaattccaggtagtgtcaaactggatgaggaactacggagtgatggaggaagaagaggggaaaagcccttttggaaagagtaggtggaaaaagttttctcggaagagaaaatatttgagcagagaactcaacagggcagggcttctcaacctccgcactgctgatataaggccagataattctttattatgggagctgttctggttaatgtaggaggcttggcagcatccctggactctacccactagaagccagtagcaatcccctatcccagatgtgacaaccaaaaatgtctccagacattacccagtgtgccctgtgagggcactccagctgagaaccactggaagtacagtaggagagagaatgaaagagtcagtcttccaggtagaaggaagggccagtgaaaggcatataggtgggaataagctgggtgatttagaagaacaggaagaagtttagagcacgtagactgccgaagtcagaggagaaggaaatggtcaaagggagagtcagagaagtagtgaggaaccagatcacatagggctttgtagatagccgtgggaggtttggaactggagtggcaagagaaactactgtaaggtttgggcaggaagaggatttgacctgattacaccttgaaaagctcactctcgctgctgtgtagagaactgaacacagggcagaacagaagcaacaggaccacgtaggaggcttgtccaggcatcaaaacgagacactcgttctgtagactgtggtgatggcaatggggatttggagatgttgccagatttgaattctacttcagtggaaggactgatagaatctgatgatgtattggatgggaaataaaaggaaaggaagccaaggaattgcctaggactggacatgaacaactgggtggggctgctgccatcaaatgggactggggagaactgagcaatagcaggtttaggtggaggaatcagtaggctgtcttcttgggcaagtctacttcgatatgcttcttcagcattcaggtggggggtttgcataatgcttgacacatagcaagggatcagtcaagggggcaagaagaggggaaaagcagacatgcctggacaataagagcataaaatgatttacatgatttacttcaccacggcttatgaactcctcatttaaagtatgcatctctctcatatatttcaattaagacaaatttagatagaattttttatttgttggttttgttttgttttaaacagagtctcgcgctgtcaaacaggctggagtgcagtggcgcgatcttggctcactgcaatctccacctcccgagttcaagtgattctcatgcctcagcctcccgagtagctgggattacaggtgtgcaccaccatgcctggctaatttttgtaattttagtagatacacggtttcgccatgttgccaagcctggtctcaaactcctggcctcaagtgatccacccgcctcagcctcccaaagtgctgggattacaggtgtgagccacctcacccggcccaaaaattttatctgtctcattcacctgtacatttttgcttccaatcttttccttaaatatgagagttgataagagaaattatttgggtatctggaatccatcatccacgagaatcttggttaatcttcatgactctccctctgtttatttattaaggagtaaatcaatggcagagttaattgaaacaaatctctttagaaaattttccctatggtttctcacattccaaaaaaagttacactcctgggagaaagattacacactctgagctgttaactacagaaaaaaagtgatttttaaggagtttaagggtgatgtttatatttagagcaaactgggctccctgttgttgagtcgagaaattgctattggtcattatttaaataacctcctgctgattctccatggagcatgctgcacacacatgtctctgtgcaaagcatctccatcccaagtgggtggctgccattaagagcatctaccactgcaacttcaggtttttgctttttatttgaaatcattgttttctcttccttggccatcttaatccatacaacacagctcttccaattattagcacatggaaccttaatttcagattctctgggacaggagttggcaaactttttaaacgaaaggccagaaagtaaatattttagactttgcaggctgtacagtctatcccaattatgcaactctaatgttgcagtacaaaaccaaccacagacaatatgtaaatcatcgagtgtgactgtgttccaataaaattttatttacaaaaactggccatggctaggatttgggccatgggctgtaaatggccactcgcctctgctctggaggattaatcttttagatgatacccaaatgtctgtagagtgacttccaggtacacagtatagcccatattaagtcagtcatttagaatacagcttccagccaggcgccatggctcacgcctgtaatccaaacactctgggaggctgaggtgggtggaccacctgaagtcaggagttcgagaccaagctggccaacatggtgaaaccccgtctctactaaaaatacaaaaattagccaggcgtggcagtgctagcctgcaatcccagctacttgggaggctgaggcaggagaatcgctcgaagccatgaggcagaggttgcagtgagccaacatcgtaccagtgcactccagcccgggtaacagagtgagacaacatctcaaaataaataaataaataaataaaacaaaacaaaaatacagcttccaatagatctgttgaaaatctatcgtaatacctataggtagaactataatatattttcttttcaagtttcatgttagggatttaggcatttgaaattccaatagagtaagtaagtatttggtggtatatcagttatgcttgttattacaatagggctatataataaatcactccgaaacattgtagcccaaaacaacaaccatttatccgaagtctatggatcacctgaattaatctggcctggtttgctaatcttaactgggcttgcccagctgtctgcagtcaattggtaagttgggtagggcttgcttgtttcagatagccttgactagaatgacttggtcctgctccacctggtctcttgtgccccagcacactatccagggattattctcatggcatggctggagtccaagagtgagcaagaccaactgtgtcagagagcatgtgaagtgtataagaccttttgagacttagacccagaacagtcatgctctcatttccactgcattcttttggttacagtaagtcacaaggttagcccagaattgtactgaaacaggactgtaaaggttcaggacaaaaagaattgaatacagagaagcccttaactggggtcatcagtggagccaatctaccaccatgaccactccaacaccagctcattactggcatgctttcaggataggaataccacttaagcagggggagggtgggagaattaactgattgacggattctttgaaaacctatgttctaatacattagatttttaggatagctgaaagatggcattgctcattttcccatatttaaccatgcttaagagaagtgctttataattttaaggatgattgccataggatatgcctacgtcgcaatgttgggtcttaacagagatatcttaagaagccaaatggcaccaaaatactccagttgtacggtcaaattaaaggaagaaaaaacaaaaaacaaaagcctgtcaggaaacaaaaacacaatgcactgtgctccccaccttcctccagacagccccccttgggcattggatgcttattgttggccacctcagtagtctggacaaaaatcttccagcaggaaatcacatcaaagctgtctcatttcttttgtagaaagctccatggaaacattatttattagaaccccttggctgcaagtaacagaaaccaacttgagctagctaaagtgcttaaaggaggaagaaaataaaaacacatcacagggatacaggttgtctctcagaagccatggacaaagatgcggctgagctttaggaaggggctggaaagcagccagggaccaagagagtactttcctcctctcatctctgcctcctttatttctctctctgcaaactggctttagcctatgtagtgataactatgtgatggaaaatggctgtctcattgttcctaggttttatttttctcagctgggattgagctaaactgtcttaagtcctaactccatatccctgagagatcggactttatttgcccagcttagcaaataaagtccactctggttcaatcatctatagccagggtcagagacaacaaacaaggttcccaggacccctcctttgtgggtgaaacaggcacttaaggggttgttgggagtcacataagtatacgtcaaaagagcttatgataggaattctctccagttttaggaagagatttcaataagaaggaggaaaagaggtcaaccctgtgatgtcatcaagtcatgtattcaaactctcttgattccgcacagcccttcaattttgtatgttctcccactcatcaggggcatttatgaggatgatctaacacactgagaagattactaacagtttaccagtgtcttagtttgggggccctaagcagaaggctccgagtcagagattcgagggcaaattgcttatttgggaggtgaacccagtaaatgccaatatgggaagaatagaaggagccaatgaacagtattaacaagcaaatcatccctgtgggcaactgcgcttaatcctgctggggaactctgagaacagtgtggattatccacccaaggtctgtcgatcatgggttgagggctgctggtcactgccagcctgcttgcctgcatgaggagagctggctccaccagccagagaaagctcacaggcagtgaggctcagaacctggccatgggatggaggtccagtcggtgtattctgaaacagttgctggccataccagcaaggggagtgggtgtaacaaaatagggaaggcgtacataggtacataggtgacaagatcttacctgcttaaaaaggcccacacgaggaagaggcaagtgtagaagcagtgagaccgaccagaaagctctgtcatgagtccaggcgcaagacgccaaagtcttgaaagagcattagtggggagaaaggagcgagctggtgggcagctgggaagagttataaggaaggaagtgttcacaggaattactaatagatcagaaagtgaaaaggatgactccaaggtggatttggttttgttggtttttattttgtcctctctggccttgaatgagcagaattttgtgaggtagtccaggccaattagaagccaggatgcaggaaagggccaggccatgctctaggactggaggcctggatctggggtgagttggggtctgattctgcgaggcacatgctgccctgtctttcagcaatcagtggccatcagaagcttttatgggggaagggtgccatgatcagatgtgttttaaaaggttattttggccaatcatgaaaattggattgttagaggaaagtgtagaggcaaagggatccaggtacaaagttaacataatcccgaaagaatgagatgggagaggagggtagacttacagcaatgacattggcattgatgcagagggatggtcaaaagagtaggtgattgattgtatgtgaggtaagtgagaaagaaatgggttaaagaaggctctgaggttcaccactgggttgatagggaggatggtaaagcttttccctgagctaccgggcacaggcagagaggcaattccaagagaagtcattttctctttgggagggctgccagatacaatgcaggaggcccagttgcatttgagtttcagataaacaacaaatcattttttagggtaagtatgcccccatgaaataattaggatatacttaccctaaaagtatttctcctatttccatgtattagatcagtgttcctaaactttgctgcagattagaatcacctggggaagattttaaacttccagactgcaccatgcagtacttgggacataccctcaaaaatgatttgtttatctgaaattcaaatgtaacagagccttctgtatttttaatcactaaatctgacaaccatactctttggatgtgctgagtttaaagtgtctgtgggacagagtaagcaggtgcagatataggtcttgcattgaacgaagaggtctgggctagaagtgcacacctgagagtcacatatagtagattattcagcctctggtttgcacacctgattgcactttggaatcaccaggaaagatatgcggaaaaaacaaaactactgatgatcagagattctccgttaattagtctatggtgcagtctggaagtttgaaagctcccccatgtgattctaatatgcagcaaagtttagaaccactgatctaagcaatggaaatagatgaaatcaccaaaatggaaacgaatgcccaagagggattcctggggagccatcagtgcataaagcgggcagagggaccaggagaaaacaaagggagggtacgcatcacagggggaggaaggaaacatcaaagccaaggggagagaatccaggaggcagtggtcccctgtgtccagggctgcagaaagggaagagaagaaaggtagcactagacttgtctattaggacaggtggccttggtggctgagggccaccagggggcgatgtggaagccaaattgcagggggtgaggcgtgtatgagcggtgagcgaggcgatgcaccagctaacttggtattcataagcaaacccttttactcctctttttccgtatctgaaaagcaaagaagatgccaccttccctactagactaccaagaggacgaaagtcagatgaaaaacaaggtgctgtgaaatttcttttagcttgaggttccggaaagaatacaacaccgactttagaacaagcactcccaccatcatcacctcccaggtcagtgaccatggtcttgatagcagtctctgaacctcagttatcacaactgtaaacaggaggtaatcgtacctatcttaataggtgttctgaggaatagatggagtcccaggacagtgcctggcacattggaggtgtttttggcttcaatttttgttttttttcaaactgcaaagggctgtgcaaataccagatgatgatgataacaatgatgatggttataaaggaagaaggaggcaaactctagaggagttaaaagatagaagccacacagaaaatgaagatttcctggatgtaacctgtggtttacttgatagagtttcagcagagtctcgtcatcacgctttccttttctgaaaagggcaggggcagtaagaagggaaagagggggaagagacagaatgaatgaataactatgagtgagagaatacaccatttctctaatttacctgttggggtttcaggggtaacaacttgaagtcttccctcactactaagggatattaatttcccttggggtgttttcctcttcatctcaccattaaaagaacctgaaaatagctatcacaaatgaggtttgcatttttccactgctgaccatgactgcttattccaatatccttcctcccgccgaactgctcaggtatgtgagacggcaggcaggatcaaagccactactcgggttaaaaattgcctaatttgccgaattataatagaactcagagtggacttcctgtcttcaaagcaccttacaaaagttaactaattaatcgtcataacaccttgtgaggtgtgcattattattacattcaaggtgaagctttagttagtggctgaaatttaaataaggccacttgatagaagtaacccaactgaaaatgtaaccaaacatagaatggctttggatttcacaaactgctctccaagaatcctgtatgttatgactaagcaattgaagactgcctcagcagccattggaaacatagaaaaggaaatcgtttactgagatacccgctgtttcaaagaagcattcaaatcagcaatttcggagggatgcagacttacctaaaattacatgttctgcaaaattaagatgtcaacgttctttgaaattattctcccaattgcaaggccccagcaaatctttatcatttggcttagagcagagtttctcaacctgggcactgttgacacctggggcttcatatggtttggctctgtgagcccaggcagatctcaccttgaattgtaataatacccatgtgtcaagtgtgggacctcgtggagataactgaatcatggggatggtttttcccatgcttttctagtgagatctgatgatttcataaggggcttcctcctctgctcggctctcattctttctctcctgccaccccgtgaggaggtgccttccaacgtgatcataagtttcctgaggcctccccagccatgtggaactgtgagtcaactaaaccacttttctttataaattacccagtctcaggtatttcttcatagcagcatgagaacagactgatacagagctggatcattcctcattatgggaggctttcctgtgcattgtagggtgtttaacaacatccctggcctctacctactgtatgccagtagcccaccaacctcttccccaagttgtgacaatgaaaatgtccgcagatattgctaactgtaccctggaggcaaaattgcccctgagaactactaccttagacaagaggtcagagtatttctctccagtattgcacatatccagagagcccctgtagatttaaaaaaaaaatgtttttgtcttccctgagccattactctgatccaaatgaacaaagaatttcagattttcccatgacatgaggggacgtgggtgagccagcacagagggtccttaaagatgcacaaaatggtaaatgctgaattttggtaactgggtgctactcacccagacaactcagtctgcatagcgactggaaagagagctggaggtgtctgcctggggcccagaactttttaaatcctcccaggcttcccactggcaatgctaattttcaaggaaggcttgcatcccacacaggacatttctggccttgcctgcctcctccaactttgcatcctcaaatgccaaattctcccactttgtagcttagcaggcagagaagcagctgaaaaccctgcgggctattgagaatgagtaattggatatcagccttaaaaataatcaatcccttccccccgcatcccttcccatctccatttcctctcttgcctccccctaccctcagaggtaaaggaaatcttaatcacttttagaccaaggaggcaaaatcatactatattaagctttttaagaaaaaatgtaaaggaatttatcccatggcagacaaagtacaaagtattaaagtataggagatacatacatctgctatgtactaaattacccccaaaattcatatgttgcaactctaatccccaatgtgactgtatttggagatagggcctttaaaggaggcagttaaggttaagtgaggtcatacgggtggggccacaatgtgataagactggtgtctttataagaagaggaagagaccccaggggtacgcacaaagggaaaaggccacctaaggacatagtgagaaggtgcccacctgcaattcagcaagtgggccctcaccagaaaccaaccctgccaacaccttgatcttggacctgcagcctccagaactctgagaaaatccatttctgttgttgaagccacacagtttgtggtattctggtatggaagccctagctgactaatatgctatagaacacaggtgaccctccatatctgcagattcgaccaatcgtggatcaaaaatatttgagaaaaaaaattgtctactgaacatgtgcagacctttttcttgccattattccctaaataatacagtataactatttacatagcacttatattgtattaggtattataagtaatttagagatgatttaaggtatatgggaggatgtaggttatatgcaaatactacaccattttgtatcagggacttgagcatctttagattttagtatctgcagagggtcctggaaccagtcccccatggagaccaagggatgactgtacaatttagcagttaaaaaaaaaaggcatagattcaaaagatgaattaagtgggagaaaataacaccactgaacaataggtacattattatgcacttgtaattttagaaccccacagacaaaaaacatacacacacacacacacacacatatgcttttgtgcattagcagatatcctgacatgtctggaaggagcgttccaatatggcaacagtggttagctctgggaagagactggaattgaggaagggagtggttaagagtttttatcttacactatttggacttttttaaaaaaccaaactaacgtagtatgcattacttgcatcgtaaaacaaaatattaagggtttttctgttttgggtttttttgtttttttggtctcaactgctcttcttagtcttctcaaagcctgaatcatgttcttggtgacacccacatcaggcccctcctgaaagtagcataaaatcatagagaatatggcattctttctggtttaaattctataaatggaccagaccatttcccactgtttcagtgtaaccatcaatgacatagtgggggaggggcacgaagaaagaacagtttcctcaaaatccaaaataaagctcattaataggaacaaggattgagacattttaattatccaggcatgcgcctgtggaatttctcatccattttaatggaatccaggaagggagagggaatacatttttaataaaaataaagagtgaaacaaaaaccaatccagacaaaatacaccaaagtaacaaaaataacccccatgaaatagatttcaaaaataaaactgaaataagttgaggggagaaaacatcatcagccagactcctggggtgatttcacagggcccgtgacagtgcacaacaattttgcacatctagctacaggaaatggttcccgtgttacaagtttccaataagaccagttaaaagaaagcaactggaaacaaaggtactcccagcccaaatgtgttctctggaacccaattgttggccctggtaggaagaataaataaaatctttgcttctttctaaaaaggagaggagcacatcattttcctttcacatagtttgtggtaattctaagaggttttaggatgatccacatgttgaatgtgggttgttctcactgctttttattttagcaatggggagggtcatttggtcccctctaaatagctttttttttgtctctcctttcttcctctatgggaataggcagtgagtttttctccctaaggctcacagacatatttcacttcttgcttctatttctccccatggctatggtagatctttagtctcatgggccttccctccatgcctggaataaaacacacacccttggccatgaggcctttgctcaggtcttgcttcctccttggaaagagctcttccttcttgcctcccttttttcttctatcaagattaagtcctccaattacagacactcaagggcaccacatacactccatagctgttaccacaatttaactcaattatccaatgtctgtctttcctggcagattctgaacttcaggaaggctgaagttttattgcttttgtttgacgctgagtgcccagcatcaagcctggaaaataatactcagtacatatttgttaacaaactgctttggcctgatttatatttttagaagacaatggagtgagttaaggtcagctaaggtataatttcccagggataagtggaaaatctaaatcataaaattcctcctagagggggtggctatagggaggactgtcaaatagatgggttggagagatagatgacattttcactagtcttgacacattctgcagccaataaaagagatactgtctagttctagatttcgtgactatctcaaatgtactcttgatttctcctttggtcccaaattagggctggtcatatcaatggtaccttctgggtcactggactggaccagtgttagagttgcttacataaatactagagcttctacgtaaatgacactttttgtcagtagcattttcccaagagtatttttcccctaaattttaaggcttgtatgttattttggtcataggaatgtcacactccactcattcactcataacacaattatttttcagccccaaagttgcctgctaaaattatttgtgggtagagatggggacagagacatcataaatactttggaaaccaagaacttgctagaaataattttccctcttcatgactgctgattgtcaactattcaatattctcttgttaacataccacatgttctatttaaataagaacataaaatatttctcaaaagaatttaagtgaaaaaatactatagcttaatcttgattaaatgatggtgtttctgacctgttcttgagaacaactgtccttattagtgaataaattcagtggtgacaggaatgtaaaacagaattcacaattgatatatacatgtccattatgtttatatttggctaataattttgtgcaagtaggaaggttgtttagtttactttcggaaaataatctcacaccatcttttctttgagctgctgcatcatcgcaaccttaaaaaggcaagcatagacaccttatgaagaaaagagaaagcaaagcagacacattcaatccccatcaggctatggggttaaagctgatggacaagggcatggctctctattaaaatcacctggggccttttataaaccccggctacacccagagcaaccacatcagaatctctggaagtgggcccaggcatcagcgcttttcaagctccccaggtgattccaatgtgcacccaaggtacgaaccattggttcagcggctccgctgagcctggtaactctcatctgatgggaaaaggtcccacagactgcaagcactttgctaaaaacagctgctcccaataaaagaatgcaaattctcagtaacatcggtgtcaccagaaaaaaggaggattaggagtcacaatttatctcttcaaaactatttaaacaaaccacttaatggtaccaggttttaaagtataaagttcttcactgcagcatgtttttgtaataacaattgcgtgtccatagaggattggttaagtaaattgtggtcaactttagaatatgcagctatgaagagacagcacaatacttttgtttactgagtatacaaactatgtcctgggcactactccaggaccttggaattcatcagattcaggacaaagattcttgccctcatgaaacttaatgaagaaacttattctagaagaggccagctacgtaactggcaagacttggtgcaaattgaaaatgtgggggtccttattcaaaaattactgaaaattcaagaccatgagagcagagcattaaatcaagcaaagggcccttctaagtgcaaggccctgtgtgagtgcacagtttgcatctccacaaagctggccctgattataaaggagacaggtgataaacaatagacaccttgggaggctgaggccggcggatcacctaaggttgggagtttgagaccagcctgaccaacatggagaaaccccgactctactaaaaatacaaaattagcctggcatggtggcgcatgcctgtaatcccagctactcgggaggctgaggcagaagaatcccttgaacctgggaggcggaggttgcggtgagctgagatcgtgccattgcactccagcctgggcaacaagagtgaaactccatctcaaaaaaaaaaaaaaaatagaccatgagtaagcacatagattacacaccacgttagaaggtgttgagtgccgcagtggggaaaagagtagaacacgggacacaacttgcaattttaaatagggtgatcagggtaggatgcattggaagaatgacaattgagcgaggatttgaataaagggagggagtcagccgtggatatctgaggaaagaccagtcccaggcaggggaccagctagagcaaagcccctaaggctgagtgtgccagagtggaaaagaggggccaaccccatcccggaggacctcagagcctactctaaggactttgacctttcacttgacattttaaaagagtagctctgcctgctacagggagaggaatctgtaggtggcacagggaaaaggcagagagaaccgtaaggaagctaatccaagagtgggggagagagaaggacaaagaatgggaatgagtgacgtataaaaggctttatttttatgtgtgtgtgtatatctatatatacatacatactcctaacttgaagaaatacccacaatatgtaaggtaaaggaacagttcataacatagtaagggctaatggcccattttttcataaaaactatatatacgtacacatatacccatacagttatacacacacacacacacacacacacacacacagaaagactagaaatgtcacgaatcaagctgctaataacagttatttctgtggattgggattgacaggtgtaaggaagaatgtcactttttatactttcctgaaatgcttgaatcttttattgtaaatatgcatttgtaaatatgcattcgtattgtaaatatgaattcgttttgtaaataaaaactgcttttaaaaatggggtatcataggattgagtggtttctttcttcacactcaaacatggggaatggctagcaaagactggataatacatagacaggcttctgtaacttgagaaagatgtggtcaacttaaaaaaaatgaaaataagattaggtttgaaacaaggatctggaaaaaaaaaaaaggctagtaaggtgggaatttgtaaacctgtagaaaacccagtagaatagtaaatgatggaccttacctaacagaagaaattgggtacaaagtgttctgcacgtattaattaaggtatagggaagagaagctgaaggatttaggttggaaataaaatgaactcttttagtaagaggaaggtaaacatgggcttggggacttctgaactttgagaactgcatggtacaggaggggttttcgtggtaacaattgctgccctggacagccccggtggctaactggattctttccacctctctccaagtccgctctcccatggtgctgtgaggccatctttctcaaacttaaacctgagctggtcacctctccctccccgaacacacacacagctcgccggaggccctgttaaaactcttcagtggtcttctgttattctgaagtctacaatctggaacaagtccagcctggcacaacccttattcccttcacaatgcaacccttcccttctagaccacactcccttgcacttgggcctttgctcagcctgcactttgttccttctttcactgattagcttcctcttccttctggcctcacttgaattataaccttcttcaatctggctaaatttcctattagttgctatcagaggaccccgtgcttctgcttggtatgcagtttgcaagcatttgtcttctccccaccaactacgagcacttgagaccaggaaccaggcatttctagcccccaccatgtacctggcacagagctgatcttcaataaatgtgttgaggaaatgagaaatagagtagcaagccttgcctattacacatgcaggaatgaacagcctttctgagatattttcccttcaattccacaatcttatgagaccaaagagaatttattctctgagggataaatataaagtacagcacttaatggagtggtgtttagagctctcagctgtgaagaccatgcctttattccctccagagacatgacaataaagacttttcagttaggtggaaaggtgatgcagtcaagggtagcagtcgcatgcaatacttgagtatttactgtataattcaacagttatcactactttgcttaaatccatgtacttgcaaagagatcttgtgctttggatccattggacacctaataactacactaatgaagtaaagccacactcctcttgcctctgacaatgaccacaatgcataaagacatcacttaggggtgggagggagtagtcaaacaattttcacagaagatccactcctgcaaaaaataccctaaatcattgtgttggagagggcatttcccttcacataagcttctaatgatttgtattgccaaagcacttggatctcactgtgctaaacatccacgatgctgatggtgttgcctcaaaggagaaatcgcttggaggaacttgaaagggcttttccttttatgattaatgcaggccaccaaaggtggtctcggattgcccccagctggaaaaatcctgacggcataattgagtctctgcacatttggtgtggctgtttatggcaggcaaagaacttgcatgacataagggctttacaaacagcttcaactgttggttaagccagggaccactttgagatgccatcttttataaaggagatactagggaagtgagcagagttcataattaccatcctggtgacaaagcaaaatacagcaaaggagatgggttggaggaaggcctactattcaacaaaatgccttttgaacgcccaggagattaggttctggaggaaaaccccaaacactaagtcataaaaaggaacaaccaaaaactgtgtgaaggaaactggaaagttattcaacactacctgatccacccccacgaacgttaggtcacttgagaatggttaactttcgtatctagtgtgacttgggagtatatctaattccacacacatctacctcctgaagttagacttagagatgactttgtctcagttttcacagcacagcattttggtttcatattcctcagcaatggttaagtgtagtattttgttgaatagtatgtactatactattcataattaaaaggccttcttccccattttaatagagtgagaaaataattttttcttacaggcacggtggctcatgcctgtaatcccagcactttgggaggctgagttgggcagattgcttgagcccaggcatttgtgaccggcctgggcaaaagggcaaaaccccatttctataaaaataccaaaaattatttgggcatggtggcatgcccctccagtcccagttactcgggaggttgagcagggaggatcacttgaacctgggaggttgaggctgcagtgagctgcgatcatgccactgcactccagcctgggcgtcagagtgagaccctgtctcaaaaaaaaaaaaaaaaaaaaaaaaagtttttttcatttattttgattggaaaataaaccaggacaacaaaaagagtagagtactcattgccacgcagaaatcttcctcaattaaaaaaaaaaaaaaagttcgtgtcatttactgaggactcttctgattgccaaagatgtgtatctattcttagctctgtgaagtatgtccttttacagatgaggaaatggaggcttcagaggaggttaaggaatgtgcccaagaatcacaccagaagtgatgaagctcttagcttggcaggatttgttttattatcagggttctgtgctatactgtgctgtgctgtttaaactttcatgtgcataaggcatagctgaggatcttattaactgtacattctgactcagtaggtctggagtagggctgagaatctgcatttctaacaagctcctcagtgatgatgaggcagctggtccacagaccacactttgagtagcaaggcactatgctattgcaatggcatagatcctgctctttcaacacaacggcatttcatcaagttggagtcaggggccctcaattgattacttgaccctgatacatttgagacaacatagagacaaggaagatatcaatccagaagcaatagtggttgtggaatgcatacatttccatgtatttttacagtaaaaatgcattaaaaaatctttcacaaaagaaacttaaaaaatacaattagggtgttgagtcctcccccccaacattctttcaggcatcaactgtgtaacggagggagacaaattcctaaatcgtttgatttcatcatacaaaatactcatccattatctctcatcaagacatttacattaagtgggggaggggggcggcgggattaaggaaagtaggctcacaagaatcagtttccaatttaaggttacagcagttcaaagaaaactatatctttctgcataatgcatagtccctgtacagtacaatatttccaaacaaatctgatgtgtggaattcaggtgaaactgccacaccaaaaagtccacggattgagacaagcccaggtgggtagcacatagattttaaattgccaaatatcatcttacaacaagaaggacatcaagatgttaacttcaggatatattcccaaaatccaccttgatttcatttatttaaaactctggatcacaattgagagcatcagtcatttaacatcacagattttgttagaactagtgagaagaatcctagcagtggagccctgggaataaaatctccaagtcagctcttaggaacttgatgaaaaagaacatcattattcagttgtactcttcctcagccttactacagctcaatgtatgctttgtatggaaaactttaataataaaaatagcattcacagacttttccctcctttttagctacagaatgtatattgtgtctgttccaggaaaggaacttgttttataaatgtccacacaactacagctactcattctaatgttatgtataaacccataagtcaaataaagctatgaacaatgtaatatttatatatgcatagtgttttataaaaagattggcccacatactgcttttcatcaatacagaaagagcattaagtccatagcacactgcaagaaataaatgagtgaagaacagagaatgcaaacaagtgcttaataattcacaagcaggctcaccatggaggaaatgatgatattcaaaccaactaaagctttagagaattacttatatagtctcccattttaaaacaactttacatacctgatttagtttacattaaaatatatccccatgaatcaatttgttccatattcagaaatataaacacgtatcacattcctcacagctaaattttgtcataaattctcttttatacaagaaaaaaaggcaacagttgttttcttttttttcccaacaggctctattaattacaatttttagctctgtacacgcaatgattggctggttttctttttttttttctttttcctttttttttttcttacagtaccatgggaacaacagtgattgacttgcaaagttttctgtctctatggaaaatgcaaaacagtactacagaaatacacaatgcactgtaagcagcggtttgctgtagtggtccaacaggtacaagcaaacattttggctcagctaggcagtaatccacttaaaccacatcccggggctacggccgacccaaccacagctcctgtgggatcaaaaagaatgggtctgtttaaaaataaaaattgttatgttttgtgctgctgtccaaaggactcaaaggacagagtcatgaggcagaagtttcccaaccagacctagaatcactgggaccacttccttcctttcccttctaccaacctagagacttggactatggtttcaaagtgaaattggcatttctaacaatgaatacccacagccctcacttctttaaatatcaacagagaggttccttccaccaaggctcattgcctcctccccagtttggcaaagggcaaccatgggcttctactaaaagggaggggggcatgctttccaaattggggatcttacgtcttcctcacaccaggcacactgtccccccattccatctactattcagcctccaatcagacgagacaacacgaaagatgcttgttgtctcttcctcgtagtaattgagcaaagctgtgatggcattgccttcaatgagattttatcagatgttggtgatgatcacgaacctgactgtctgtgcttgggctgtatttgagtaaaagtggccgacatttttgtctgtgtgccttcctgggccagggagagtacaaactgttttctgaaccaactataactcacaatataaaacttctttgtgctgcgcagtttagctataaatatccttcatttgcaatagtagtcttgtcatacagtttgcttacttttaggatcatcggcaaacctaatccatccccaagggtcctcagcttttacaaataaaactttgcatttttgctctttgcttttaagaaaaacttccgactacagtatagcactacatcactacatgacagtctatatcaaattaattaaacttaatcaataaattcccttacgtagagaaaatgatcaacagccccatttaaccaggagagaaaaagattgccccaaaacgggaacaattcttgacgattctacaggttacgtagaaacaaaatttatatccctttgggccagcatttggcaaataatttccaaaaaagtatgcatttaaaaatactttctttaatatgatacatcaggcacaatacttttcatatatattttttcttataagatttcaaatgcataaaatgtttgttgttattcataggatcatcaggtgtcagatgcttcattaggtaagaaactaaataatttcaggtttgtgactttcctcttagaacctttgacacggtaaaggttggaatgtgactcagcgtctcagatactgaggtcggtgctacattctttgtaaggtcgccttctctgctccgggggatgtctggaacttctgccggcatcctgtttcagattcgcctcttccctttctcggtggctggctctgtcctctctgttccttttgtccagggaccgctctctcctgcgctcgggggagcgtgcgcgcctccggtcggtggacttggccctgcgctcgggcgagccccctctcctgcgctcgggggacctcctctgctccaggagtctctccagagaccgtctccgccggctgggggagccgtctctcctgcgggtgggtgaccgctctcgcctccgctccggagagacgtctcgtctcttctcgtgcttctccctcctctccaaagtgttgtcggcgctgcgggtgccctccctccgcttctctggggaccgcctcttggggccgttggcggctgccgcgcgctcggcctgcgcgtccctccgtccctccggcgcccggtccttgggtcggcatgccccgctgtcgggtttcctcgaagtcccattccaggtgtggtgttcattgggttgtctgctatactctctgctgcctttcggatcccttgcgtgtgcccgcttttccccatgtggtgatgatttgtgaagatcgggtgggtaactggactccaatgacggatgctgccggcggtcgggcccggccctcacttccggaacaccttgtggaccggtggcggggccgtggcggtcgctgctggggtctgccaggaaaataaacgagagcaacagttgggtacgaaggtccctcggctcctgtccccgttcccacccacactcgagacctcattagtcacaacaagcaaacaactgttaaagcagtcagactcaaagccaactgaatctgttaacttaaggataactgcacgtagttagggttaaaaactagtacttgtggctttcagcgtctggctgactgaatgttctccatacccgagacatagatcattaaagaactgacaaaaatcagtcatgatttgagtctttaaaggcacaatccaaatagtctgtctagaggcatcaaaatttcctctctgtagctatcccttgttcttcctttcccacccccccaacccttttcccctgtgcccacccgtctcccacacccaagaaaatattctttgctttaaagaatacttgttttgatttacttaaaaataatttagggtattgatgtgaagaaggggcacctgggaagctttctggagcagggcaggaatcatctacatcttatctgggtggtgattaaatgggcgcatacagaagtgaaaaatctactgcactgtatattcaggatttatgcattttaccatatgcagaagtatacttctatttaaaaaaaatccagggtagcaggcaaaggggattacagaggcaacatgctggccagatgttgacgactggcaaatgggatatgtacgcaagggcccattaaactgtcctatctgtattattcaactacgttctctacttttgcacacattaaaaaataaggaactgtttttaaaaggtgttttctgatagataaaaggtaggggaagagaagctgctaagtacacatttgagattggatgggggtcaaataaaatttttggtttagaggcattttttctttatgacatgggaggcagtcataatgacatctaagagcttggagtcactgggctgcttcctataacatcaaggtttctacaggtttaaaagcagggcagcccataatggcccctatttatcattattcaatatttgaaatgacagtgcaaatgttttaggcagtgtcctgaattgaggagagctcttttcaaagctaggatgctttgttgcaactaaacccaacaagtcatccacatgacaccattccaagcaaagcacctgaaacaaggcactgcagtctggagggcagacttgtatgacagtcagagactaaggggtcactggggctctttaaggatctttcatgagccaacaaggtcaatatttagcaattaacctgtttcatgacaacttcccaaaacctagagtgggtttttaacaaaaagcaagtgaaaagccaaaagcaggggtcagccaactttctctaaagggcaatagtaaataatctgggtgttttgggccacaccatctctgttacagctattcagctctgccactgtggtataaaaacacaggcaacacaaaagtaatgggcgtgcctatgtgtcaataaaactttacttacaaaaacaggctatggacaggattgggcccatggactgcagtttgcaaagagatacctgaccaagcaggaaatctcgtcttcccatctagcaaagccctacgatacagggctccatgaaacaaggttcattctttctaaatactgggttggctacgagaatgaacaaaaaacaggttcttaacaaaggtcatgtgaagatgtggatacaggaaggcacttggatcaccagtggcttcttatgcctacttttaagacaagggaaggcaacacttcaacagggtcagcgttgtacttacaattcaaagaacgcagggtgctcagaatgaattgccaaacatatcaaaacagagctaagcagaagcaatgaggaaattaggccacagcacagaaacacctagtattgattgagctacaaaccgtagtttgattatggcccataaggtagaagcaagcctccccgagcttttcatttctcatacatgcagcgatattaggaggtatcatcgctgtggaagggagggcccagcaccaagaacagtcagagagaaggagaaagagagaaagagaaaaagttgaacatttagattccctataacacagaggaaagaaaaaaaatctacatttgttaacatagggcaaagagagtttatttgtccagtcagacagtctaaggcaacactcaaataaggctgcagagaccgcaatcggaacagtgacatttttagacagccataaggtgactcgagaacccagacaacgaatgcatccttttttgttttgttttgttttgttttttcaaacaactggaacaatgacaggctggcataggagagcattaacaataaacaacaaaagaacaaaatcccttcccacccccaccaaagaccgcggcagttaaattaagtacaaaaaactcattacaaaaatagcctcacagagaagcaggttccaatcaagtcagaaaaatattggaacttaacatattataacccatttgtgactctaatcaatggaattagagagatttagtccaagtgacgcatggagacattacagtagcacaaccctgtggcaggttcaacccttcttggaaaaccatgtatttaaatgatctttatttttagcccaaagaacatttgttagtgttggattttcatcctcagtgcaacagacataggttttgagaaggtacacaggttactgacgatgactctcaaatgaaatatcacatccaacagaagcatagggaagacagaaaagggagacaatgttacacagtttcagtggtatcaatacacctaatggtcagaagttcagtacagtgcacagccacggcatcttaatgttgtcaaaatacttcccctgtggttggccatgtctataggggccttgtctaatacccaccctccccctgtacctcggacccctcgtattttgcacctgtacaaatgtcgaacacctgggaaggctggccctccaaggagctatccttctccttgagctgcatctgaattaaacatctcatcaagtccaaaatgcaactgagaattgtgcagaatgactttcagaaaagagggtgataatagataaatccctaataaaggggaccaacgtatctggggaccattcaatcacagtttctatagaaactttggtagacctttggttgggaaaaaaagccctacatctagggcatagcttcttctttttttttttttttttaattttaaacacaaatctcaaataaataggacataattattatcatatacaatattttgccatcagaacactaagctatgtaaagatcattgctgtctactcaaatcaagtctaaagatatgacaaaggaactctatgtataacctggctttcctcataggaaaggtatagtcacatgtttccctcatgatgagcactgggaatttatttcatcctttatcatttaaaaacattatggctaatatattaacagtttttgtttgtttgtttgatagtagtgggctcagatggtctgatttggggtaagacaccagttgggggatggagaagtgttgtatacagagcataagggaggttagcaaagcccccaaatctctcaaaatttcatgcctcttaaataaagacaccaagtaaccaaaaaggaaaaaataattgtgcctcaacatatcactcaggaaacctgctttcctgcttcttaaaaggagtatatagtcattttgtgctaacaattggatctgaggaacagtttggcacagtacaaacaaacattccttcgctcttggtcggactagacaaaacgttctctctgattatcagaaagggggctataaagatcttgtcttaggccatgccccagtccacgtaagcaagcaaaaggatgaaatgtgtagagatttcagaacaagcgaggcaaataatcacatggtgcgagaggctggtaagacactggtgaataggggaaacaaaaaagactttcctgctgccgttctggagacaaattcatggagtcatgccagggaaggaaggaatgttttcatagtttgacccaccatattctggtactgagccgtctccccgcttcagaaacagacgaactctgcggccaccattcttaatcagttctatagctcgagaatgcttcatgtttttggtggtctcaccattgatctctaaaatttcatcaccaatctgccaaagcaaaagaaaactaagtgagatttgaaattcatgtacggattcaccaaatgtttattaagcacgtggcagaacatctattgctttggaggtggcagtgacaaaaacaaacagaaatccctgccctcatggagattatattctaaagagggaaagacaattaagaaaattagaaaactacatatatgccaaatcacatgagaaaggggggaaaaaaagcagtaagggcatgttaatggttggggtaggcagcttttaagaaggctcccatgatttctgcctccttgcattcacaacctgtgtaatctccccctgcctttgaatgtgagctacgtcaagtgacttgcttctaataaacagaatatggcaaacatgatatcagttcaaagatcaggtcataaaacgattttgtcatctgtcttacttgccctcttttcttctctcacttgtttgccctgatgcatgttatgagctatcctctggagtcccatgataatgaaatgagggactgccctataaggcactgaatcctggtaacaaccacgtgagtgagcttaaaaagcaaacccttccccaggtgagacttcagatgagaccataatcctgactgatgtattgaatgcagcattcactttgtgtcagccactattttagacactggaaataaaagaataaataagacgaggcagatccccactcaaatagagcttatattctaaaaagaggaggaatggcactggctttcaagtctacagtctttaatttgaatcctatcatttggtaactgatttgctcccagtactttaacttcctggagtctactttcttacttatagaagaggctgataataccactcacacctaccaagctgctggcatcaaatcaggtaatacatgtaaacctgtcatgtaaactatacaccattatacaaagtagcataataatatttcatttgattaactttttaaagagattaaatttttaaagtaatttaaagtaaagtaatttaaagtaattaactttttaaagtgattaaaaggcaagggaaaataaattccttatatctgaaatttcaaacaaaaaaaatatgtaccaccatgtatctccccttgaatatatacatgcaaaagaaaagaatatgagagaaactggtatactgtttggccctggacactgtatttttactacatttttcactgtttaattttcttaaaacacattcaatgctctaccttctcaattttaaatgttaaaaaattcatgctgaacaaacttaaacatcaagattgtggcttaagtgcaagtgttacgatcctcacccttaatcagtttttccctttttctgctcaggcccaactgcattcacttttttcctttcctggcctgactgtcttgatttcttttaatttgttgtaaatggctctccatgggcaattcccaatctatgtgacctatctatgggtagatgatttatgttttcttaatcatctaatctgcccaggagaacagcacattcatctacagtaacagatattagcgaaacagagcagagtggacttttggcatttatgtattaaaaatctgtagctcttactacagagcaactctgaatattcatgccacagagccctggctctttgctaaggcagagagtagacttgctgtctctgagcctaaggtaagaccactggtaaccagctagaggataagtagacctcactgcccagaatctacagggccatatggctttcctgctttctaagcatcccagggtaccccagaattcctgtcaagtgatgtgcctgccccatgacattaagcacaaaaactatagaaatgggctctgaaaaatatctactttaatatatttgaaagtaatttaaatcctttattccctatatcaaccccaaagagttggaagtgttcacctaactttagcagctataattaattgtgctttaggcagaaatatttggtagggtaggagtcatgcacttaagagaatcatgaaagctatagaaaatgtagttcttatgaacatgaacattctaaccatatatgacaagaattcactgcagatggtttctttgcacctaccccagactcctctctccacttaccctcatctttccacacctctccgcaggaccgtcctctgctaagcgcagaacatagaggtccatgttatactctcggcctcctcgaaggctaaagccaaatcccttggctcctctttccagttccacagtgtaaaaatcttgctcctatttaaagaaattaaatgcaatcattctaggagaactaatatccataggactcttcctaaacattcttggcaaaaaggcacaatctctatccccctcttggtgactcttgtttattaataatcttgattcatcctcattaatctcagaagtcacagatccagaatttgaaaacagttatgagcatgtctatatgcatctgtgtatttattataacatgtggattaaaatttaatcagtgaggctgtgatttgcatttggggaaggacaattcctcattacatgataccagccacctggctgctggatgcccagcctccctgacctgtgtccaataaatgctggctgtgcccatcatgaggataccaacaaaacctctccaaatcctgatcaaggaaaattatgaagggataactgaaagcccccaggcaaccagtaaagaaagaacccagctggggacttgtaataccagctactcaggaggctgagacaggatgattgcttgagcccaggagtttcagtccagtctgggcagcacagtgagacccctgtctcttaaaaaaaaaaaaaaaaaaaaaaaaaaaggaatctgtttaattttgcatcacccaaagttcctcaaatttgtttcacctgctagtattttcacactctccctcgccatcctgaggacaggcattttgctctatggatctcaccttaaattctcaagcctgaaaaacaccttatcacaaagacattttcttggcagaagcatgtttatgaatactatgagtagatattggttgctttgctttctctaactgccgatccttgtgacaattactgcttttcattttttttcccctagaaaaggctatctaggaatattttaaggtagtaaaataacatgttatttcctagacaatcaaatgtaagtatacgtttggtaaatcacctcacaaaaggttatttcttttaaattaaaggtgcttcaaaaaatatcccataaaagtagcttgagaaagttggaaggaaacgtgcaaagtatagagaaaaaagagacatggtgctcacctgtgttgcttggggtgctttgaactcaaattgagattcctgctttggtttggtggtattcctgccaaagtgaaagaaataaatataagagcaacccattagcaaactgagaaagaatcaaggacatatattgtcatgctgggagttacttttttcccctttaacaaaggaaaccagtcatgtctgaccttgtctcctgggtcccttgctgagaaggggtgtgtgtggtggtgatggtggcaatcttctctgcattggtcagcaaggtggcattcgaggactctgcaaagagggacagagcataaagaaatgaagaccccagagaagacatcctccagccaggaggtgtgcagaagccctgtatctgaataacaagtgtgacttctctgtccccatttcaagcagtctgacttgaatttctagacaattaggagtttaataaaccattttaagatcttctctgatgtgggtcatgtatgtccccatgaccctcctcccaaacagacatctccacaaataaaacagagtttgccaaagaaaacactgctctaaaattctagccaaggtatatgtttctcactcctcccctgccactgaaaaaaggcagtcccatcaaagtgctgcaccacagcagaattctcttccagaactttaaagtctgataattaatgtctctaccaatgtttcctgcaatttatcagcaatatttagtgagtcggcttaatttcctcaactgaatattaatatcagaagtgtactaacaacttgttaaacacacatataatatccactttctttcccactgcttttaataaagcacaactgaaaatatggaactcctgacagatcttgtttggtatcactcatgaaaagtcctatagtaatagctatatgttctttactaataatttcttcattaagaccaaggcaagtagcaaccaactatgagcaagttgtatttttaatatttaattgtaggttgactgaaactcgtcatacattttctaacaaagaaaatgctaaatgtggtgttaggttccattataagattcacctgtgcatgcccatttaattcagtgcaccatcaaatctagaagttaccaggagacctatggcttatagtaggcactttcgtgtttactgaatacatgtatcttcccatcacatttaactattatatgggaaaatatgttaactattccaaactgagatacctataatatatatctttccactggagtcctggaacaaaagacatcccacaaatcccaactacctgtggtctatcttccatttacatttcccaaggatcttactcagctttggtccggcttcctgttattttattttcatgacacatagtggttaaaagcatgggcttgagattcagacctgggatcaaatcacctttttttcctactcattagctgtgtgccttatttttctcatctgttaaaatggggtgatgacaataattcccctctcatggataaaagtatatgcaatgtttaagctctgtgcctgacatacaataagcactcaatacacatttattacagctactactttttattactatgagaccttgtataagttatttaagctctctgcaaaatgagaaagtcgaaatatgatttcaacagttaatttactgcagccataaaagcccattattcttctagctaaggcacaagagtaagaagaaaataactaaatcaagtgaattgttaggtgaatcccattcatgttttgggacaatgtttcccaaaatctgttttaccaatcatttcctatgcactcctctgagtctttactacaccaatatgcctgtgaccgtccaagctggggaggtggtgtttctcaggcttactgggagacagtttagcacaatggtgactaggtcagattctggagtcagactgtcttatctgactttgcattctatgctcttcaatttcctggatgggacttaagcaaagttacttaaattctcagtgcctcagttttctcgtgtgcacattgggaataagagaattatctaaggaaattggggcaaagatgatccaagaagattgtttggaatactgcctggcacacaaaaactgctcagaagtgattagcatatttttggtaccatgtgtttattattgtcatcataatgttaaaagcatattgttcgtatattttaatgacgctattttaacagcaaattattttcagagcttttggaggaaaactagctccttcatatgactcccatttgagggcagttaaccagcagaaccaaggtgatgaatcagtgatattttataaagtacgctcactgtgtcactaaataggacaaacaagctgtatagcccatcgctgtgactctccagaactttcataaacacgtgtattggtcctttagcaaacttcatattgctcattgcaattaattttatggagactctcagaaatcaccaggttgttcaggccatggggaaatcacaatcaggatactaaaaagaatgtctccttgtaatcaaagtgattataatgattgaattgtacagaggttcctctttacagttcttgtgtgttgttggtagccagagttttctgagcagatcagattccattctcaaattatttttatttttctgctgctttcataatttgatgagataatcacccaatacacagaattcctttattatttttattcccatcctttatttgctattttttttcctcatctgtatgtctgtgaaactcttttttgggttgaagcttaattttaagcatagtaaaattaacatttagcatggaaatgtcgatttgaccttgctgaattttcctcatttgttgtttatcttaatctatgaagcaccaccatttaaggatggtttaaacgtgccaagcactgtgctaagtccattaccacatacttcatttgactctcaccactcaataaaataggtgcaattatggccccagtttacaaatgaagacactggggtgtagaaaatgtaggtaatatgtctaaggtcactcaggcagcaggtggagatactgggaattaaacccaggacctgcctgacagtgaacttttagtttttggtttacgtaggaatcatgtgttggtattgaggaaatcatatctaattggaacattcctttcaaaaaagaaataattttattttactgtataaatactaccaacctcaccaagcagtatcagagatgaattaaaatatgaaacaccctgctttgatggctagattttataagccatcctcagagcagcaccaaaataattttaggtataccctagatttccaggatgtttttatactatcaataaagttatgcttgttttaatgaacttttacttcttcatttggaattaaaccaggattgtatttgctgaaatgctctctagcgctttaaaatataaagatgagcccattataaaaaagagctttatcccaaagcaaaattgactacttacggtggaaaaaatataaaagaagggcctgaaacaagagtatgagtctccctgccctccagaaacagtattagaaagaggtgtcaatgtatttgacttttaaaactgcaaggcacatggacagattaggtactttatgacaaattccagaaagtacccaacatcctttattaaacagtgtttatacctactttagctctcccagaggagtgaaaatggagattactacactttcaatagcagtcatgtatcaagagaagcaaatcccagctctcacagccctgtccagggactattccaaatctcggcacttactcttccaacagcagcttccatcttgggtttcaacctatctatctgtgacaagcaattacaattctaaccttgttcccatattaatatcctcagcctccccttacggaatccacattgaaagccaagcaaatcaacaaaggatacaattattcctgttgtaaatattttactggataaacacgtatgtaataaatatctaagggcggcatggggaaatttgaatcccataaatatttgaaaagttttgggggactttttactattctaatgcctttgccaaggaaacagcaatatctatatgttgccaagctctacctcctacataagcaaatactttgaatcagagtgatctgaagtgcaaatttaggaccattattcaaataaagcatttttaagcttctaaagattttcattatattgaacttgattcaatctgatggttccatgttacctggctcagggagcttctgtccttgtctgattaaagtctctctcccactccatggggcatctccatacaatgcaaatgttgtttgacttcttagatttcaagttcagattcagtaagttcagctattctctgggcccttctgtgctgccattgtgtatttattcattcatcccttgcccatatctcacaggagagaaggttctgccctcccccattgtccaccctggtcccaaagagaatcaaagcaatgaaggtaaggactcccccaaccttggcctgaccaaggctgtgaaaacactcctgccagaccttctaacatacaataatgccaaggaaagaggaatcacgttttggaggttttgttggaaaagtcagagaaaaatgtgggaagcagagtgagggaaactaaagactgagatgagtgaaactgcagaaagaataaggctaccgatgacaagagcaaagaattagatagcatgaactagacatggaaatggactcagagtagactcacgcactgcacaaagggcagagcatcttttcaaagggcctgctggggtttcgagaacagtgtcccagacgtgatggattctttttttttttttctggagacacagtctcactgtctcccagcctggagtgcagtggtatgatcttgactcatagcaacctccgcctcctggtttcaagcaattcttgtgcctcagcctcccaagtagctgggactacaggcacgcgccaccatgcctggctaattttttgtattttagtagagacagcgtttcgccatgttgcctgggctggtcttgaactcctgagctcaggcattctgcccaccttggccacccaacgtgctgggattacaggcatgagctaccatgcccggccccagacgtgatggatttctaagagcttagaaaccactctgagttaagaccttcagtctccttgtagatatcatgaaacaaatggtttttgggccacttgatgaagtaaatattcgagtaaaaaatctgaaagagacctgaggcataggcacctccattttaccttggaatcaactatgtccaacacgctttcacagaaaggaagtggatccagtgtgattatctcttcactgaactgtaatgctcactctttgtcttctgggggtttgcaaaatcctcctggatctcccacatcttttgagaaatctaactcccctgcttcaactctaatttccaaaatgctgtttctcagacccacttaaaataggagcatcaccatgaacccgggaggcagagcttgcagtgagccgagatcatgccactgcactctagcctgggtgacacagcgagactccgtctcaaaaaaaaaaaattgagcatcacatattcaccctctgccagacttgattccctttaccgggcttctggcacttacaaagtaactagagaagaggcttattatcatatcaaccaaattcctgaaacatcttggatgaaatcacatgctcagcagaacatgtattgccttaaaaaatatcaatcctcaactatgttgtaccagttttatgtttacttgtttctaaccaaggtagcacaaggtgtctatgtgaattttatatttcctacatatttaaattttaaaattgcctttataatgccaactgttattggataatccaccttgcatgataatttttggtgttcaggcttaaaagttttttttccagggtattttattttgtttgttctgagacatggtctcagtctgtcatccaggctggagtgcagtggcatgatcagggctcactgaagctcgacctcaacctcctgggctccagccatcctcccgccagcgtatcctgcccgttgccccaaatagttggactacgggtgcaagccacctctcctagctaattgttttgaatttttagcagagacgacgtctcgctatgttgcccaggctggcctggaactcctgagctcaagtgatcctcctgcctcagtctccacaagtgctgggattacaggcgtgtgccactgcacccagctgtgtattttattaaattaagtcaacatctactatctacactgcagaataagtcgcttctgagtatttatgtctttactgacttcaaactctttttctaagctcttcactcagggagtactttctttccttcttttggatgttctcattcccacaataagattgaccaattataaacccagcaagtcaatccctgcgtcctgttcttttgggttagtctgtttgatatctttccatgacatgttgataaacgtgtctaaatccatacacaaagcatacctcggagatatcacgggttcagttccagatcatggcaataaaaaagcaggtattccagtaaagtgagtcatgcaaattctttggcttcccagtgcatataaaattcatgttcacactatactatagtctattaagtgtgcaatggcattatgtttaaaaacactacataccttaattttaaaatactttattgctaaataatgatcacctgagccttcagtgagttgtaatctttttttgctgatggagggtcttgccttgatgttgatgcctgctgactgatcagggtggtggttgctgaaggttgggtggctgtggcaacctcttaaaataagacaacaatgaagtttgctcttccttcaatgaaagatttctctgcagcatgttgctgtttgatagcattttaccctaagtagaactttttttgaaattggagtcaatcctctcagactctgccactgctttattaacttaagttgatttaataatcaaaaccctttgttgtcatttcaacaaagtttgcaacatctttaccagtagattccatctcaagaaaccattttctttgttcatccataagaagcaactcctcatctgttcaagttttatcatgagattacggcaattaagtcacatcttccggctccacttccaattctacttctcttgctatttccaccacaaaggaacttctgcagcttcttcctccactgaagtctcgaaacccctcaaagtcatccatgaaggttggaatcaacctcttctaaaatcttgttaaggtcaacatgtctcccatgaatcataaatgttcttaatggcatctagaagggtgaatttttttccagaagattttccaaatctttccaaatggattttccaaatccattagagccatcactatctatggcaggtatagccttacaaaatacatttcttaaatagtaagacttaaaagtcaaaatgacttcttgatccacgagttgcagaatggatgctgtgttagcaggcatgagaacaacattcatttccttgtacatttccattagaactcttgggtgaccaggtgtattgtccatgagcagtaatatttgaaagaaatttttttcccctaagcagtaggtctcaacagtgggcttaaaatactcaataaaccacagcacaacatatgtgctgtcatccaggctttgttgttccatttctagagcacaggcagagtacatttagcatcattctgaaaggttctaggattttcagaatagccagatgagcactggcttcagcttaaggtcatcagctgcattagcccctaacaagagagtcagccagtcctttgaagctttgaaactaggcattgatgtctcctctctagctaggaaagtcttaaatgaccatcttctttcaatagaagactgttttgtctacactgaaaatctgtcattttgtgtagccaccttcatccatgatcttaataattaaatccgctggaaaactagctgcagttttatatttgcacttgctgcttccccttatacttttatgttacggagatggtttatttctttaaatctcatgcaccaacctctgctagcttcaaagtatcttctctagctttctcccctctctcagcctttactgaattgaggagttaggaacttgctctggattggactctggcataagggaatgttgtggctggtttgattttctatccagaccactcacactttctccatatcagcaataaggctgtttcgctttcttaaaatccatgtgttctctggagtggcacttttaatttcctttaagaaattttcctctgcattcacaacttggataaatgtttagcatgagggatctagcttttggcctatctcagcttttgacatgccttccctcactatgcttaatcatttctagcttttgatttaaagtgagagatgtgtgactcttcctttcatatgaagagttagaggccattgtaaggttatttattgtcctaatttcaatactgctttatcttggaaaagggaggcccgaggaaaggaacagagatggggaatggccagtcagtggagcagtcagaacacatatgacatttattgtttgtcatcttatgtgggtatggtttgtggcacccccaaacaattacaacagtaacatcagagatcacaggtcatcacagcagatataataataattaatactaataaaacttgaaatattgtgagaattaccaaaatgtgacacaaaggcacaaagtgagcacccgctgttggaaaaatgacactgacagacttgctcgaagcagggtggccacaaaccttcaatttgtacaaaatgaagtacctgcaaagcgcaataaaatgaagtgcaatgaaaggggggatgtctggaccgcatttggctctctcaatcacttctcactatattttctggcttccttcatccttcctattaggaacctatgttctatcatcttgtgaccactttcctaaattgtaacagctttccagagtggtgaattggtggaatgaactccagaccagttggtaagtgactaaccatgcatttgaaggagggtcaagtagatcatcattcaagaggccagtgttttcctccacatttagtgtgggatatttttggtgcagagaaagttctctgttcttggaatcaacaattttaaatttttactgtttggttttgcatttaccttttccgtaaggcaccggctatacctttcaaatcttgaactataaagttcactttctagcagttagtatataaaaatactcatttggtaaataactttcagatgaaaccctaattttcttattttatagatacatggcatagagtttttatcacactatcttcataaactagattttttcttgagaaatactcacttttagaatatatattttataacatgtatagcaagactgaaaaaagacatttaaacattttgggacaagtgtcaccttcctcccaagagcaaagtcagcttagaataaagtgaatattcaggaactaattctctaaaggatctatacttcctggccttagtgtatcaacttaactttttttttttttttttttttttgagatgagtctcgccctgttgcccaggctggagtgcagtggcgcaatctcggctcactgcaacctccgcctcccaggctcaagcgattcttctgcctcagcctcccaagtagctgggactacaggcatgtgccaccacgctaagctaatttttatatttttagtagagatggggtttcaccatgttggccaggctggtctcaaactcctgacctcaggtgatccacccgctttggcctgccaaagtgctgggattacaggcgtgagacaccgcattcagcctcaacttaatttttattaaacatgaataatacaatgagtattggtattttgtgctgggtaactttttattgtgagggctgttctgtgttctgtaggatgttttgaagcatgtctgacctaactagatgctactcacacccactgcagacaatgccaatgttccctggggggcagaatcaccacttacataaaagaaccaaagatttgaatttaactaatcacaaaaacaaataaggacaggcctagtttaatgcagatacaatttatcaaaaatatagagatttcattctttcttcattcacatccaaaaattagggaaaatccagtagacacaaactcttagattctcccattaaatgaaaaactttgatatattcacttattctaaaaaaccatagtactggctctgaattgccaccatgcaggttttctcatgtcaccatataatacagctcatattatacatatcagaggatctgtaccacctgtattaaaactattttatagtgttgaagacaaggacacaaaaagctaaataagttgaggaaagggtgaagatttttctgaaactttttttttttttttttttgagatggagtctcactctgtcgcccaggctggagtgcagtggtgcgatctcagctcactgcaagctccgcctcccgggttcacaccatcctcctgcctcagcctcccgagcagctgggactacaggcgcccgccaccgcgcccggctaatttttgtatttttagtacagacggggttccaccgtgttagccaggatggtctcgatctcctgacctcatgatccacccgcctcggcctcccaaagtgctgggattacaggcgtgagccaccgcacccggcctgaaacttttatatttgcagcaacacagggtcacagggctacaggattaattacacaagagggtgaggtatgggttagtaacaatggctcacgtttacctgatgggtatatttagttagggatgaataaagctgccactaaattaatactattcagttacacgaacactaatcaaagagagagaaagagaaaaggaaaagacagagacagagagagagaaaaagagagagagagagagagataataggtatactttaccatccccaggaatgatgcggagggtaactgtgtttcccgcttccttgattaggttcacaatgtctgaatgggatttgttggtgatggaacatccatttactgccaagatccggtctcctactttcagcttgccacagcggtcagcagggctcccctcaataatccgacctattttgtgaggcatagccacacatgcattgcctgctttgatattgagttttaatttttttaaagttacgtgggaatatagcaaagggaagagaaaaagggttgaaaagggaaagagaaggttaagtgttaataaattaaagcattaagcaaatgttattaaaggagagctctgcaccgatggtcaaaacattggcaatactcagggtgtctgtataaggagctactgccctgaaactagaattcattgctgccatcctttccagattcaaaattaggggaatccccagctttcctccttaaaccaattacaaaatttgggatagttggcaacttcaaagatttttaagagccccaaaataactggctgttcgcttattttgggactgcaaatgtgaaacccaaggctgggatggatgcttttactcattctgtgttcatgtcacttcatttttgccagctgttgtttaagcttctgccaatgttttgttctttctctgtttagaaaaataatcactgggcatctggtgaggcataagagtctgctagcaccaaaaattcaatctgaaaacacctgatgaacaaacactcagactttctgccttctccccagaatgatgaaagctttagaaaaagggtgtaattataagagatgagccaagaaagcacccaaccttgaagcttatttttccttttaggacctttgctcaagcagctagtcttatgtgctttcagagcgtggcctgactggttcattagctctgaaatcattctgctgcctcacaaaaatcccctcaaaggactacgaaaatctagtacctattcaggctgaggacattgatccaaagctaggttcaaatcattcctcaccctttttcctttaatcatctcctttctcatcatcagttacccatatcaaagaccgagaaaagtgcatttggagagaaaggtttattcgtgcactttgaggcactgcatgtcattgctaacttctagagagaggtggctggctttgaggcctgacataggatttctggttaatctagttaatcatgtattgagtttcaaagttcttatgcatattcacctactttgagaatttgtctttctggggactatgaaggtagttatgcagttgagttaccttttggaaagggtgacaaataacatgagggacattacaactaactgagtaggctcttctgtcatgatttggaccttaagggtaaagtgtgtgggaaaatgcactttaattcctttgaatttcagcagatttgcctgagcttgtatcacagaatggaacaccaaggtaagataatttttaaaagttaacagtctattagaatacaataggtaggtgtgctggaatgctcccatactcaaattcaaggtcttgactaagtttagttgatctccaaggacaattggtataacaaaggtatcgaacagcaggtctgaggaaagctcagcaaagctcagaagcctcatgcaaggtattagggaaagtttaatttgttcgttgtaagagccaaaggaaaacaatcaaagaccaaattgtgagtgtgaatacaatattcattatataacacataacctgccacttgacatatttgctatttctttctagaaggtgaaactgacaattctgaaatagttaggaacgtcacaggatgcatggagacagtcaaactgtagatctgaagaaaataatttgggatttctttctcccctcttccttctctttatttttatattaagcaagaaagtctctgaaattaattttaaaacaaaaccaaaaaaccttgctttgatgtcaggtcatccatccatgacatgctatgatgactttattaatgtagctcaaaaagcactgttagtaataggcgtttgttactgcagccacacatgcatagacctggctgagtcactgtcccctgttaaacataaaacttacggggagacagctccagcaggaagcaacacaccaggattaaatggaggccaagtgagctctactggatgagaatgctaaagggttgtagcaccttgctgattctagccagtttccatgtggataagtcattcagggatagagctgaggtacatgaaaagcccacacagcctgcacagcccttccccttctcccattgtattccatagtaagtaacaaatgtgcttgggagataacaaatgactttttacccaatcaggaaggtggatcatttttggagtgtacatctataatcaatccattgcaatgggaagcagattcatatatcactagtttctgcaatcatctgggtttctattggtctttgctagtgtacccagaagagagtgaatccttctgagaaagtgacaactgtgtttctccatactttgctgaaaccctcaatgtctggacgagacaggaaaatcgaatgactcttaactcagattttaaccagactttaaatcaagcaacagtaaaaatattatttaaaattaaaaaaaattcctatggggatagagtagagaaagaacacagatgaggcagactagcatctcatgtagtatttttactccttacacctctgtttttcctagagcatttttacagccgtatgctccttgtaaaaactcttaagacattcttaagaccattctgaggcccttgcaattagtgctatcctattcaagacctttcgaaagccttgctttggcaaaaactgtagactctgtatgctgtccaggggttcctattcaaatttcttttctttcctttccttttcttttttttttttttttaagacagagtctcgctgtgtcacccaggctggaatgcagtggcacaatctcggctcactgcaacctccacctcccaggttcaagcgattctcttgcctcagcttcccaggtagctgggattacaggcatgcactaccacgcccagctactttttgtacttttagtagagacagggtttcaccacgttggccaggttggtctcaaactcctgacctcaagtgattcaccctcctcggcctcccaaagtgctgggattacaggcgtgagcaacagcgcccggctgctattcaaatttcacgcaaatctgatgtatgctttaagttgtgtatgcgtgatcacattctcagtgtggaagttgaaagggttgaacaaatattcccaaccttcaaaagggaaaaagctaccaaatcaactccatctccaattaagtctttaattacccagagcaagaagctataaagcatttctgcacgtgaggtctgagtcagctttcactcgcaagagaacaaaaactcccaggcatggtgggaaaccctgggtaatttcacgttcagcactcaccaaaggtcgtgcctgcttcgggcctgctcaccgaggacacgatgacgaagccgaagccctcgttctccccgcgccggatctccacgtcgtagggctgcaccacggtgctgaccacgccgctgcccccgccgccgccactgccgatgccgctggtgctgccgctgcccgagctcaccgtgttcagcgagttctggctgccctgcggagtgcgcttctcttctgtcagcgaggccggctggttgctactgtgatgagaggaggctggcgagggcacctcgttctcggttttgggcactgtagcagagagatgcacgcgtacatcaccgtgtcctgcagcccctccatcctgctgcccctccctccttccagcaactcctgctagaaatcaaaacgtgaaccgaggggaggagacagcacctggtttcacaatacctggatatacggattgaaagcagcttctcttgacaaatattaaccattcagtatctacgaacattgatcccacctaacaccaaatgggactcccaaatagcgtttgttgtttatagcatgctatatgtcgacatccacactcagaatcaagtctgcagcaagatcggcctgctgtgaaatatttccccattgcacaaagggaagggcctaagcgtaggtgagggctacacccgtgaagaccgccatcttggcttcatagatacaaccttggatgcacgttcacattgtcattactttccagtcacatttccacccagctttttccatcaggcgacaaacagtaaggtgatggtaacgttgaggctacccgccctatgtggggttcatgacaacacctgtgagacatacacatgcttctcttcttagcttccaggtgtcaacatcgactctgatcacagaactggatacactggcctccttctgaatttagtcaccgttctagtgttaccatcagactgcaaggtaaagcactcctaaatagccaacaccgtaggtggaaccaactatgccaaaaaacaaaatgtgtgttgtgtccaagttttggatcagactgtatttatttccaaaagcttctcttttcatagattgttttaattttggaaaaataagcataacaaatttttaaaccatttttaagcatacagttgagtggtattaagtgcattcacatttttgtgcaaccatcatcatcatccatctccagaattttgtcattttcccaaattgaaactctgtactcattaaaaactaattccccttcctatttcctccaccccccaccaaccatcattctgctttctatctctataaatttgactaccctaggtatctcatataaagggaatcaatatttctccttttgtgactagttcacttgcataatgtctcttcatagatttgacacgccttttacacagagctaaaaatccaaaatatttaagatttaaaaaaataaacctgaaacaacaaaaaaaatcacattgccttactatttctatttgggccagggaagcgagatagttagttttcatctcatctcaaaaactcgttccagctgactgcttttagctacatggaatagtatgttaagaaggattgtgaggtcacaaacacactggaatttaacatcttaattctataattaatcatataccatttaaaatgggttatactctttttttttaaaagaagttaccaattaattttatctgacaggtatctgtttcactaatatgaatgccaagagaattcataatatttcaggtcatatttctccagtaattccactgatagaagacaatcacctctgctgcactctgggttctgccttaaaggtttcaaggtgggagctgcatccaaaggtgaacaaccaaggtgtgttcaacgtgagctttcaagggaaaggacaaacactcacacaattcactgtctcaaaatggcagattctgatacagcagtaaaccatgagtcactagaatggcaaggagggaatgctaaaatctgaaggcagttggaggaaggaggaatttccaagggaagaaagttatatttgagctgagcctgaaaggatatgtagtattttgagaattaaagttcaaagcttatgggcaggaagaaggaatcaaagctgacctagaactggccagctctacaactttcttgtagaaagaaaaaaaaaaaatcttggtttaatacataggacagtaagaaatcagtaacttttttatgagcttattttgtagcacaaacccgatttttgttcccttgatatgaagctacaactcttctgactttcataatgacctcatttgctgaggattagcatcaaatgaagaggatggctaagttctgatttgcaaggagatagaagggaagtaatatatattcaactagccttcctctggaagcctttgttgaacacatgcaaacggcacattaaagtactttagaatgacagtaatttttgcagggtttgagagaagcaagccatctggaaattctgagcttgatcacatttgcaaacatttgctaaaatagacgctcaaggaggcagacacaggaaggaggccttttctgtgaataaagtgacaacgcactgtctgaaggaatgaatgaaatacatacccgcaaaaaccactttacgccgcaccgtgagattgacgtggccttgcttggcagcttgttgcataagctggaccacaagctggtgtgattttccaattactggcgtcccatccacacagattaattcatctccagacctcaggcggccgtcagtatcagcagcacccagtggtacgatgtgaccaatataaatctgttgagtaattgaacgatggatgaaacattgctctcctatgtttactgttacatcaatagccttcacatctctgggaacaattcattcattcatgtctgcaggcatgccgcaaacatttattgagcacccactgtgtacaagacattgtgctaagcactgcaacaattcttaaatggtggaaagagtatttcttgcttagtttccagatgtttatctgtggcctattgatgactcactctctttttcccctttgcagatataaattacttttctcccttcattatataccctattcttctttggtagctacctaaaaactctctttccataaaactctgctaattaaaatattaatattacttttatttaagggtctagcatcatgcctaggaatagggaatctgtaataaatactcttaaatgaatgaatgaagcaaaagttggttggacatctccatttttgaagtcttttagcacccgaaagcagagcactctttatagttagtgtcttgctgttatatttgccattcactaaaccttagctaaaatatttgtgcctgccttgcctttccagcagacaataatgctatagctacctttacgtggcatttatagtttacaaagaactttgacaaaatagttgctaagaacatgaactcgagtcagaccttatttgtcagtccctccatttggtagctctgcgatcttgggcaagttagttagcctttcttttccttgatgtgaaaacgggataaactggtgggtttgacggataaatgagagaatgtatgttaagagcctttagcacagaacctggcacatagtaagcgctcgatgaataatggctgttattaccacaaggaaattaacgatacctatttcagttttcttttcttccttcaaaggaaccctgttatgttattctaaatttattccaaaatggaggacactgaggcccagggaagttcaatgtttcttgacccttactcagggttctttctcaagttttgtaaaggcaggggtctgacattctccaatcactgtctcataaggctttgcgaagtactctctgcacaccagcaactcaacatacaaagcctactacctgctggcagagtgaagggacctggccagaaggaccaggccactgtgatattaggtgatgcctattcctgttttgctttctgttttcatctcccttgggggaaaaggggtggtctacagaggcagctcccacctttcacaaacactcatacaaactttttagaaagaatctagtctcttcttcctcaagacaaagagagctccacaaaacccaatgagaaacccacactactcaagattaaagagtcagtgttgcatctagctggacttaaatcttggtgatttgtcactgtcgccaatttgctttgaagccttagaaaaatatgctgggaagagagacaagcaaaagactcacaggttcccctggttcatttccacccagaatcctaaatccaaatccagtctcttttctccagaggaagatgtcctgttcctggtaatctggaactgcagagaggggagaaaaaagagaaggattattttactgataaaagcaatgatacccccaagatgaacacagttgcaggacaagaatggtggtgcttgatcagatggaagattttcaatataggcaaagaaacaaaatactctgaacaggtgaaataatggaagacacggggataaacagtgggaatagtcactgagccctaaagttcttcacaggacccatcactgtttgataattccgaatcaagcccaagccatgatccttaactacaaatagtcagcattaactgctttcctcagtattcttgcaaggagaattaagtaaattaaaattattatgtgccacaccacaaagcaggtgtccatgtccaagaacactcaggctaagtcagagtcacctctgaagccagatctaaggattcggaagtcatgttaagtcaccagatgtttcctctactagaggatgaaagagaacagcttggtttaaacagactttctgatttatctttaagtcactttcttcttccttaaaataattaaggctagcaatgctaataggctttgttagatcatttttgccaaaaattactctaaaacatcctagtatttctgcatacagtcagtcctccatatctgtgggttctgcatccttagattcaaccaatcacagatagaaaatttgttagacctacaatggttttagctgtgatgaatacgtacagatttttttcttctcgttattccctaagtaatacagtatcacaactatttacatggcatttgcattgtattagatgtcataagtaatgtagagatgatttaaagtatataggaggtggggtgcagtggctcacagtggcactcccagcactttgggaggccaaggcaggcgaatcgcttgagcccaggcattcaagtctgggcaacatagtgagaccttgtctctacaaaaaataaaaaatgagccaggtatggtggtgtgtgcctgtactcctagctattcgggagctgaggtgggagaatcacttgagccagggaggttgagactgcagtgagccatgattgccccagtgcactccagcctgggtgacagagtaagaccctgtctcaaataaataaacaaacaacaaacaaacaaataaataatataggaaggggtgtgtgtgtgtgtgtgtgtgtgtgtgttacacacaaatattaggctattttctagggatttaagcatccatggatttttatatccttggtgggggatgcgggtgtcctgaaaccaatccccagcagacactgaggggtgactgtacaaattttattaggatttcaatactattaccaaaatcagccaggcctccaaatccttaagatcaatggtgatgacaaaaagtctatgttaatgaatcatatatctcattgccaaaatgactgctttactctagaatttgcctatgatatttcagcattaaaagtattaattcattttccagtaacctgatattttactttcaatactcagcaatggtccagggctttaaaatgaatatcttgttttttaaaacaaatgcaatttccataagaaaatacttactatacatgaaattgttctatacaccactctgttacttcactaaagtaaaagagttatttctatttaattcttacgtaatattttaatgtatacatagggtgttttatgacctataaaatgatatatcatttttttaaagagaaaaaatatatatttcagttgcagtgaatcctaaaggagattttcaaatgctatagtgcataccttcttatttaattaactggatttggggctgaaggaaagcgcaggcctgagaatttaattcttttcttctccagttttgtacaatggaatagggaagaagaaggtggatgtttagattttaggttggcgaagagatgtccctttttagtgattcacccacaaacttaaaatgtatagtgaatgaatacaccaacagagaagaaaccaagtgaccagtaagtacaagtcagaggagtttgaatctgatctttttacttgagctatctcagtgccagggctgtaaatgggtgctttctatccactgcttttattataattgctgaggctaagctgcaaaacacccagaacatggagctaagctactgcacaggactcccataaacacaatttgagagtaatattttcttgagcacgctaaggtaacaatattttctttctgttcgagtagctggctacaggatatttgctgtaatagcctcaatgaaacaacaaattaaatcaagttgtgtctccgtctttgagtcactcaagcaagaggattattactgaaatagaccactggtgctttccagccagcactgggctcctggcagagtctgttttaggtctgctgagtgtgtggcttttctgggaacaacgaaagggcctctgcagagacttccagcccagacccatttttctcagcatcatttaacaccagaacatttgcccatcctacagtgacaccaaatgtaacaagtttctgcctactgttgctcatttaggtgtgagctagcatggtatgggaggttgtggccaacagatttaggcttatcacaccgtttaggccacatggaaaaaaaaaaaaaaaagcttcgtttccttctgagaatcagtggtaaatggcaaatttatttaaaggttttctgttgaaaaggaagatgcccactgacactagggatgttaaagacacaagagtgagccagaaaacacagacataaacgtcgacacacagacacgttacaaagaaagtcttgctactttaattttggtattttaagaattctactcttctaccaactaaatgccatttaccccaatttataactttggcaataaatcagtactgaaacacattatgggattataaaatttctctcttctgtgtcctctgaggccacctcttcttagaggcattgaagtttctaaactacttcccccaaaatggttttcttccttacttcaggcagattttattagaattaagtttttaggcggcagtaaggtagaaccattttcccaatattaatatcactttttttgagtgaggctaaatcaaatagagctaagaaaaccttgtccaattttcatttgtaagcccctgcatatgaacagtttctgcagttagtctcctttgggtaatgccagtgacaattcaataaagcagtcaaaagacttcctttgataattagaaagaatggacccaccagatttgcaaagaaactgcctggtgtctccattactacagacaaactaacacatttccagacttgacaagggcatgcaaaaccctttttattccatcttgtctttggtttgcgtttggtcaacaagagctccaaagcacttcccttcatgccccttttttcttccctctcttttctgaacttctccccaggcccccagaccaatgagaacatcaaacaagatgaatgaaaacggagagacaaaagttttcagcggatccttactcggacattctccaaaattcgtggaattgatttctctctctctctcacccttgctcaatcccgacgcaggtgaaggtgacatagctggaatattaatttcacaattttgcaaagcttaatgtacattctttctcttagttcactttaatttagttttgattgataaggaacagtcagttcagctttcacaataaaggtcatggctgttatgttaaaagactatagtttgattccattttttctttctttttttttttacagtgctttacttgtaaaaaaggtagaatttacaattgcaccactgagagtttcctataactcctattactatcttaaactctccttatttaatgacattctaaagtacacattcttgaatggccttacttcaatcatggtttgtctaaaaccttattgctttttgaaaaatttaagtatatttgtgctaccactatactacagcatttattcaaaagtgtatcaagtccaggatgaaattcattcttgtactaatatctgttcaggtgaattctaagcatttcaagccagaatagtcttatatttagagatgcagatcaatggatctatccgagaactgaacaaacacacaaatacaaactcataattgctcttaaaatctggaggtatatccaagcttcttaagctcactatgataaagaagctcaatcgccacttccaaacttgtaagcatgtctctccaaggcaggacagatttacaatgttggttaataggacagttttcagttttttctttccaaactatatagtgaacaggcaaagtttcaactataagccttataatttcttttgtagtaaatgctactggataggatctgattttcctaaacatttactaataacactgcatcgctgtcgtttttaagatgtgcacaattctagagaaaccataaaacaggcaacatggcttttaaaggacttcagtgctcgtctttgtttttaattaaacattgaaacccttcaaaaggattcatgaacacatttgtaattcagactgattcattctaatactgctgccttgagagatggccatatcaaaaatatggtacattgcaacacatttagaccatgtgaaggaatgcgttcacagattgtgttaatctccacattgcccctaataaaagaaaagaaaaagaaaaatgtatttccaacaaaaagagggtaatatggcacagttaagctgctgttgctgacttcaattttcctgtttttcctggattactctgctcattttactgtcttggggggagggggcagggaatcacatctaacaaggctatacacttttttctctttgaaagacaagatacaaaacaacctaagagaatggcagaaactgatctcagataaagaaaaatactgattcaaagacgagattgatgcacgatcattcctaggtgctgtgaaaataagaaaatctgtgacagatactgaataattaccatgggggccagggggaggtctcatcattatcctcatttagtagtgaggaagaaatccatgtgaatgttaacatcaattaggttgctactatctatccgtcaactacagagactccaattaccaaaaaggaacaggttctcatttgtgctgctctatccgattccttagatgttaaagaaagtgaaggaacaaaactggcaccattccgaatttttttttttttttttttttttttttgagacagtctcgctctgtcgcccaggctggagtgcaagtggcatgatctcggctcactgcaagctccgcctcccaggttccagtgatgcctcctgcctcagcctcccgagtagctgggactacaggcgcacgccaccacacccggctaatttttgtattttttagcagagacggggtttcaccatattggccaggctggtctccaactcctgacttcgtgatccgcccgcctcagcctcccaaagtgctgggattatatgactgagccgtggcgcctggccccgaatatttcagtccggctgccacctgagcaacttcagtacttacagtagctggctatggccacattacatattttcctaatttttttttcctagtgaaaactttttagacacatttgattaagtcaaattcttaagaaaatttgccgccaccagggtaaaaatggcatttgagcaagagccttctattaaacggatgttttacaattgtcctgtcaacccaggacgcccccgccagcccttcagaatgcaattcattttatcacaaaaagattcatacaggaaaactcaatcataaatgtgtactgtattgaggagagcaggagttcggtcaataaagcaatatctcaacattaactgaagttgggccattgactggacgagccacaagctcagagagaaatgcgcggggaatgtgaaaacgctcctctttggaaatatctcttaaatggttttcttcagtgaaatcactacagtgagcgaggagacacaatgaggacagaacctggttcctggttagcatccactgcatatgaggtcattccaaatggaacttcatttcctttagtcaggcctcaggggtactttaggggtgtctttctagtccagcgactaaataagtccctgctcaaattagtgggctttttgtcagcagagtgaacttgtagccaaaacagcctatttaattccatgcattgtggtaccaagaaggcagtaatatttctcccttgaggaggaaaaggatgaagccctgagtgactcctaacatttgataaccagcaagactccaggctcacctctgccccccaactgctgagcatcattcagtggactgaccaactttcctcctcagacaaggatgctggcctcactgccccattttgcttgggtcacagaggagtcgactttcagcatgcacctcggccggcaaaggaagcacagcatggccaagtctgtgtagtggacgggaggccagggacccacacctcacacaacctctctgccacgactctcgatggggaccctgctgagcagtgaccacatttgcagctaggaatgaaacctgtgctgaggggaggatgagcaaaatgattcccttcactcttccagcttctcccagacccttcaacaaaccgaatctccaccatcacaacacctctctcctaccccataccaaaaagagaaaatgaggtatctgtccttcatagctgcctcaccctgaccattataagaaaacatcagaaaacagccacccaacaacaacaatcaatttgcatcgcctaaaattaaggcatttttaggaactttcattggtaagataaatgaatattatttatggtgaatagtttttggaaatcatttcataataaaaagacgttaaacatgagggtgatattatgtttatacaagccaagaagttacaaagtatactatcactggctcatatttatagaaaaggtaaagcactggataagtaattaaagcacaaccactcactgctatggttttttccttttcatggggaatgtttagagagattataatggttaaaaaaaattaccagtatttttaaaaatcaagagaccacttaaaaagcatttaatttcttctcattagcccaaaatcccagtcaaacatgtttaagttctgttgcatatcagatttgtgctcagagcacatcacaatctccactcggagaattaatgagacagcagctcttatctaccattccttttaactgaagggacgaaaaaacccatttttacccagggcatttatgtgataaccatccacttctaccccctccccaaagtgaaggcatagtggagactccatgaatagccagcagagtccactccctctgtgatacttttgcatcttgcggatttcactttacccagtttacacactgcaactcatctattttcaataaccttcaagagaaaggtagagccctgcggaggggtcagggtaagacagaggccaggatgctactcacgtcggttttcatacatgctcctggactgggcccagattttaaaaggatctggttttttctggccagagctgtcagtttgatctggagcttgggcctctgcaggtgggaactcggggagcacctgtgtgctgtggcttggggatgctgtgtgcaggcttcggtggctggaaacactgtgctgagaactattctggctgtctttcctttccagtggttgctgaaagtaagcaagtgagaggggcaagaagaaaagattattattggttctctgaatgggtgctttccaccagcttgtctttgtttagcacttttgcatacacatacatatcaacagtattttggctcccacctttctccagctaatgctgaatgtagataaatccccaggtgactggcagacaaacagaggggtgggccagataggaagacataatcataacccatactgctctctgggctacagcggaaaacaaatctgatattcatcacaggttctcagctaagacgctatgctcgtttactgcaagatggatcagttttaacattttcattttcacaaaaatatgtgacaccaaataccatgagtggtttaggataaggctataatatccagaagaaatataatcagggctaaagatgctcctcaggactccatgtcttgtaccttttaataataaaatacccaattcctctctaagagtttgctatccattcttttcgactattaaaaaaaaggaggtcagatcttttaaaaatcatgcctagtattatatgtttactggtatttctaggtgtagaaattactaatatatgaagaacttccataattcttagctaatcaatttggcaagcattacacttcacctcttaaactgccgatagtactgttggttgaaaaccaagatcaaactttgtatatgagttgacctctgggggccagccttcttagatctgcaacttctccaaagtccaagtattataatattcaaaggggaagagttccatttaaatttcagttgaataaccaagtccttgttcattaaaatctgctcagcaaagacccttctcattttacaaaaagctctgttagaatggggaatgaatggagagtaagacctaatggaaaggaaaatagtgggtagaacagaaaataactgtagttcttattttctccaataaaagactgtggtaatctcaggtgtttagcattccctattcaaaacaaaaaatcctgcagtcatgcctcatataccatagacaccatgtcactatacttagctgatttaaagcattgtatggggtagaggacaggaaagggctctccattctcttttatagatcctgtagagctcgtggttttaaagtactttataagagctttgaccttgatcattctagatccctgaagttctttatagagcccaaatcttccaccaggtgttccgatcaatcctatcaaggccattcttccttgctgtctccccgagtatccttcatctttcattcccctggaattctgctggaaatttgcaaggtcccttcatttaattctcaggtccctatacttcctctccttccagtaattgctttgaaacaagtatctgaagaaagcccaaggaggacaaaaacttcatctgctcttgactattacagatttgaatggaggtattggcaaggattcaaaattgagaacaattggacatgcattcaatgaaggcaaggtagactgtttaaaattatacttgatgtgcctgcaggagaaatttgaggaccatattctaacctatcctggaggtcttgggaaaactgtatgagaggcttaattcacttcaattcaaggggaaaaacatacactgttgcagatgccaggaaaacacgctgatgtttgggtgggaacaaacaccatcataatcccacgtcaccatttttctcttttgaggatcaagtgctcagctcagatttggttgccattccagagttgatagaacctggctctgccaacttcaacagtttctcctccaacagtgaattcagctcccagggccagagtgagaaaatgtaaatgatggataccatactcattttcttttgcatgcacatgggacagttgctttttttccccccctcttcaatgtggtctttacaagggtcttgattataaacaaccatgtacagtatcagccctttttttgtgtgaacctacataacaacacatagaaaaaatgggattatgggtggagtttttccctcttatcattatactttcccatattacctaccttttttacttttatggtgcatagagaatactttttataatcaagacaaaatttaaagtcattttcatttcaaaatgaaccttggtaaatagaattaacgggaactgctacttcctatttttttacattttagtaatgttttacttttgttcacctctgaaggggaaagatattttaaatgtaaaagcaaaaaactcaataaaagacctctgcatttaccctgagagtggcatgcctcccttcaaaggaccactctcttttggttcctcaaattaatagatgccagattgattccagggtcggcctataagcactaaattctgaccctggaagctctggtctcatcgtgttgaaattacgcttcacaaaggcgtgcacactgcaggattacctgcaggaaacagccttgtgctgctgcttcttttgtagggttattggcagtttctgttccattgtcttcttgggccattacctcctgaagcctaactcaaaccttttccacttgattcttcttcctgaactggagagaaatatccttctggcatccctgacccactgagaaagtctgataaaagtactggacctgtctcccagagaaaatgcgtatgtgcttttacatacatacctgtacatgcatgtgcagagattcagcatgtcacgtcatgggtttttgaaaccctctcatgtctgtcccagtataagaaatccctgacatggaagaacctagatctcttacatttaactgaagagatggttccaccagaaatagagagtgcaaatgaagtctactggaaatgcttgggccatttttcaaattataacaccctttctcacctccccaataaatgactcatttaggtccaatttaacaccaaatgacagacacaatctggaatgagtttgcaaaactgcctctcggtcaaactgcacctctgagtctcctttaaatgccatctaaactttatacctcaaactggaaaataaaagtaaaggagcatcctgagaatatgctctaaaaactgtgccaccactcaactatctctaactggcatatataaatggcacaccagtgggctaaatacacaataatctggaagctttttggatgttctccctgctaagacttaacctcattctatgttccttctcaagttcaattatgaaaactcattaatttgaagacatattctgtaatttaatatcttgtgggcactctggattttttaaaactatgctgtgggtgtgaggggagttcaaagtaattttttttttattttctgttagcattctaattagctatgaggttgtcctttatctggttagagcccagaactgtccaggagaaaaaccatgtttatatatctcccaaattaaagtcaacttgtgtgcattttcagcagtctggatcacctcccagaagactaggggcatgagaatacgttcacttctgaactatttatgacacaggagcagatttgcatttaatgcaattgtatttcacctcattttcctaggtgagacactagcccaaagacaagtagctgtagttaaaagtatacttttaagtctgttaacgaaaccctgtgcatactaagaacatggaaaaatggaaaaacctagtacacaaatgatataacatccagcccaggccctcctaagtgtgctgccctacctgcaatagatttattcacttaacccaataaatacataggatcacctgctgtgtgccagatactgagggaaacaacatgtaaataaggaatagatggtacctgagctcttgaaatttatccctgggaatgtatctaagtgtgtgtatacatagtgtgtgtagatgaatattaataaaatataatctattgatagcaacacactgcaatgtcctttagaaaggtggtaaagagaggactctggaagaaccctactaacagaaagagaaggctgggcatgatggctcacacatgtaatcccagcactttgggaggccgaggaacacaaatcccttgaggtcaggagttcgaaaccagcctggccaacatggtgaaactccatctctactaaaaatacaaaaattacccaggtgtggtggcatgcacctgtaatcccagctacttgggaggctgatgcacgagaatcgcttggaaaggtggagcttccagtgagctgagatcacactactgcactccagcctgggtgacagagcgagactccatctcaaaaaaaaaaaaaaaaaaaaagagggtgtgctaagtggactttctgaagaacaaaaaagctaatgtgacacagcaagggagggtggcctgagaggaactgggaggccacataacgcatgagccctgtgggctacgtaaggagtttgggtttcattcttagtttcaagagggggaatccattaatgaatttcaagtggggatgttccaagagccaacatgtttccagaaagtttggtgtcgctactgggtggtgaatggattggtggggaagaggagtgaatgcggagaggccagtcaggaagccccaggtgcagtcaatgtggggacctgaggtgggcaacaccagggtagctggagttacccaggaaaagaacaagtgaggtcagaagacactttgttgccaaattcaacagggattgctgacagactgaatggaggaggcttaggagcaggaggatggaggggacaggagagaagggaggtgaagaggatcaccaaaaggaggagagcttagaaacaaggatatccatgcaccacatctctactgtgagtaactggttgagaaggggtgccacatattaagataggaatttccaatgctaattgttgtcattatgctgatatttttgaagcaagagtcttattgctgagtctcaattcatagccaactaggaatatggaaatgggctcaattaaaaaaattccataaaggtctttggccacatgttggccatgaacctgtatcacaagaccttttaaactaaaactaaaactgtaccaacctctctgaaatgaatgattcccttacttactgtcaggccagggaaattgggaagacataatggtttttataaatggaaatgcgaaaaaaatcaactcatcagtatttcccagaatgatttcaaaatgtaggtacttagaaagtgaactgaaaatatttgcttggaagagcaaatgaatacagacagcacttaggagcttaaatgatgaaaagaattcatgtggcttaaaaatgacaaattgatccattttaaagcaaaattatttacagttcacttatctgccaagagcgaaggctactgcagcgatttacatggacaacaggaaaaactccaagtgctgatgaggtattaggccaacgtcattaaagggtgtgtgaaaatcagagactcgaatccaagccagtgcagaggatggtcattccttttgtttgtttcttttatcatttatgggtctaagtcaaacgatttcttccaaaaaggtgggcgagaggagttaatgcagaagaaaaggcaggcactgactggatatgaaaatgggttctggttcacattgcatgttttaaaggaatgtaatacaatggcaaagtccatcttccagggctccaaaaggcagagaaggggagttgccacgggaagtgagaggcaaggagactgactgaagtgatcctatgccttcacccatctactactctcactgtttcttcttgtaggctgtagaagctttgatgggatcaatcatcatgctggttgtcacacaagtggcatcagggaaaaggaagacaggtgccacacaactgtgtgagtctgagaaagaggcagggtacataaaacggaatgatctaggccagggtcacttagtgtgtgtgtgtaaaaggagtctctccctcacatctcttaatgactagttttcagcaatttcctttagcatctcttgcaggggaaagggacagagaggatagtggaacaaaaacctatcactgtggctaccctgccgacagcttgctatgtctgctctaaagaggctgttgaagagactgcttcttcaatgcggatgggcactggatgctttgcccaccatccagggtcctctatataaaaactttttgtaggatttttttttttttttagtgaacaggaaactcttgtctctttagtgaatatggtacactttctttcatctgacaataatagctaagtaaagaatgtggtttcctatgttgcctaggctgctggggaactccaaagtactccacagctcaatcacagcacttattcaatcgtgggtgttggcattttatgatgacttataagttattataattaagagtggaatgattacattatgtgcgtacttgcttccatgttatatttctgctttattaatgctcatcacactttaatccctatgaggtgaggatctttgtagatctgcctgttaatgtggttattatttctccctccccatttccatgagggcagggatgttttctgattaattcttatccaatattggcactgggtctggcacacataaaataataaatacttattgatgaaatgactgcataaacattttggaaatttgtggcaattaatctttttttttttgcaaggagcaatcaatacacggtttgtttgcaaactgcaagaagagaggtgccatgaccaccttatttattatagtatttccagtgcttcacaccaaacctgttatttaatgggttctaaatactagttttctgaataatggatgaatgaatggatgaaagatgaatatgtaggtggagcaacagatggataaatagaagatgatagctaggtgtggtggcacatgactgtaatcccagcacattgggaggccaagataggaggagcacttgagaccagcctgggcaagatggtgagactcccgcctctacaaaaaatataaaaattagccaggcatggtggtgcatacctacagtcccagctacttggaaggctaaggcaagagattgcttgggcccagaagttcgaggctgcagtgagctatgactgtgccactgcactcagccttgatgacaaagtgagacctcatctcaaaaaaaaagaggggacagattaagggagaagagttgggaaatgaattcatacgaaaacggtggatactgacttaaaattcagggtttggtgtgatatttagttttaaattctcatacacaacatccttgtgggtgatttagactgagagtctcagtgaaatgagttttcagtcaggatgattaagttgggccacagaatcagtttcccagagaggtctaaaacctgacagaaaatatgtcttgtttttgtctctgctatttggcagaaaaatccctgatgttatgaaagtccaggtattaaattaataaatttttattaagatactgccattgtccccaatgagtatataaaccacaatttcaacatttaaactaaatcttgaaggtgaaattgcttattaagagtaagctacagggactatccaggagaagaaacaagataaaaaaagataagtccttctgttctaataaaaactcaactacttaattattgaaaatcttaagaaaaaaaaaaggtatgagggcaaaaggaagctgccaatcacatgagcaagccaacattgtcaggagcctctaataaaataaacaaaacaaccacaacacaatggtcctgagctaagaccactgtgcacatatgcacagagctattgccaaatctaagtgagtcacaacccaggtacaatcagtgtgcttttaattatgcatcctgcataattgaccttatgtgtcattacttgaatggctttctggtaccaggacatccagcttccctgtgaattccctctgaccccaccagaaaaatcccataatcatctgtctccctggcaggacatcatcaaaattcaaactgggaaagggaaaccactttcaagccacctgtacagaactctcactgatcacagatgttagcagcactttacatccaacagcagcccttggccgacagctcccaaattttgtacagcaactgccagtgtgtgccagcaatgctgtgaaaaccctcaaccctgtcctggcacagaaatcaggtaaggacaagccccaagctgggggcttattattttctaacccagcaacacatcactctcttagcttgtggtaattaagaaccagcagactatgggtaaagcagttgagagcttctttcttaggaatgcagcccaagtaattggcttgctgcttgctaatgatatggcttctgcaaaaattaactgtcatagggaattctcttaactgacttggtgaatgcaggttcaatacctatttgatagcctttgggttcaccaggtaattccaaaacacttgggggaaacagaaatgcaaatgaattacaaaaatcctttgcacactaaatttaaatggaatgcaaaatggaaaagaacaccttgctacttgacgtcatgctacctgtgcaaaactactatgtctccctcagcacactccttgttaagactccattccatgtagggtgtgtaaaataagcccatgtatcaacatagcatggctggggttggggagaaaaaaggagggttcgtgctaactcaagcttatgagacacatcttctggatttccttccatttctctgaaggcggatgggttactggctatgaccaagggacagggagacacacatgcgcacatgcacacactttggcatctttgtggttccaatgtgggcaccaaccagcacttttctgcctggacgttaacacacactgacaaggaaaccagccctgaagtcaaagttccaatcaccacggcactatgccatcggaatcacatcaattattgcaggtttttctctttggagaacttaggagtgaggtttaaaatgcaggaagctccctctctcatctccttaataaacttctgcctcatgctgccaggcttggagacaggtggaaagaattcagctgcagcgccgtaagccgcaaagttttcaaggttctcccttcctggatggcacgaggctgtacattttccctcccccaaatcttctaaaccacatggaaacatccctctttatcctaatgttaatgaattgggaagccccttccacccagatcaatttcacaggcactggagttccagatgttgagttaagcagcattttaatttgtcattagtgccccgggagcataaacccataccaccaagcaaaacactatagcctctaagctattagctaacatgtcaactaggtaatgcatcttcagggaaaccagattggaaaggacagcaaaacattgatttttttttttttttttttttttttttttttttttttttaagaatcctatacctgcagcataatgctgctaaagctggcaaaacaacaaaggacatttctacagcaaggaaatgtcctattctcagtgctggggcagtgaacattgttccatctgagcatggtcacatatatggggcaaagcaattcttccttaaacctacaggctttttattttgtaaataattcatcctccggcgcctaagaaagctaagggagagaatgggtagacatgtgaacggctgggaacaccagttgagagcaatgctactcacggagcaggtggagctttctttttttctctccttccaaaggaaacaatagcatttgtatcaagtgaaaacggctaagaaactcatccctttgaaggagagtgtggatgcatttgtatagagaagatttcaaacatgcattctttatcctggctcctgcagcctgcccacaaatcactatacagttaaagacaagcccaaataccttgtataacaaacagatccccagaacttaagaaaatgagccccggctcctgtctcccccatccactgtaaaacacatttagtgaagtgaagccacacagagtaccctcccacctccagccccccaccatccaccccagccccaacaagcaccaagtaactgacaagtccttaccgactttgggctcttcttgggaactggcagccctggaaaaaatgcaacaaggaggggaggggggaagaaatcattagcatataaatgttaccttttccttaaagaacaatccccaggtgttccatggcaacctagccatctgcagagttatgtcagatttctccccagcatcggagttaccaggctgttcatatcgaatcaaagcagagggaggaggagagcgagaggcaggagatctatctgcattagctatgctgacttgtactgcagcagcctggaggctgggaaaagaaattcacagacctcagcggcctgggaaattgaacacttggacagaatctcaaatgctcttctggattaagagagacttaacttacaattaagtccaggttatttcctttccacacgatccacttgtcaattgaaacggaccaatcaggacagaggaaagggtatatatttagtttcaaaggagtacatggttaaaattaaaaaaatttttttggtcttttctttttttttcctctgcctttcggaagaggaaatgctttctttatttggatgagctcaataccaaaacaaagacggatgctcttttgccaacacagaatgctaacaaatgaacacaaatccaagttgctctagggtcccctctggatcatcagcacatgtctgtctcaacgtctgccagtcatccaagcaacctcctactcacagcttgttggaaaggaatggagcaggattagccctcaggagggaaagcatgtcatttgggagtgaaaaagaaaaattgcacaaagctgaaagaaaaagataataatggagaaagaaaggcaaaggtggtcattgaatccagctggctcttccaaaaccctgtccttagtgggagggctggagctggaagggacaagtgatctcctcaattctagggaagtcaggagcaattgggggcagacttatgggaaatctaccaccagggaagggtgcgaaagacaggcgagaaaggaaaataaagcgtacactggtgtttcaaaagtaatcatttctgcaagctgttgcctcttttgatttttttctttgggcaggagttagaatgcaaaatacagattctatctgtataaagcacacaagagatgcttgggatctggtgatgctgcaccggagatttcaacctgtttttcaaagtgattcctagggagtgtgacgatctcaactcttttggaagtgacttgtcaaaccatgagccatgctgagttcagcacaagtaatatgaggcgaggcaaggcaagtgggtgagtaaggaggaagcagcccagatgagccggcagagtgcccactgggagtgaggcatgatgaggattactcgtcgtgggaggcatgagggcactctctggcaaggttccttgcatcaccaaaatgaggtcaccatggaagcctggctcccagacctcagagggcataaggcacactcagtagtttgtcagaaatgcagcagcccaggtcccaccactgggggccgaggaatctgcagtattaacaaaaattccaggagattctgatacagagaatctgaggaccatatttaaggaaactctgatatggtagagtattactctttcaaatcaggcaaactcagataggcatcctttaacaaagtgctttggggccctctctgtctcagtttctccatttataaagggaaaatagtaagactcacttcacaagattattaagataatgaaacaagagaaaatgtttaaaagcctcctacctggcacagaggagttactcaaatgtctacaccttttcaccctccttagctaatttacatcattcagaaaggaagtggtatagttatcttgcactaactagagaaaaatcatctgctaagcatattaaaatataaaaaagattataggagaaaatattttacctatggatacaaataactgtgttgaacaattttgatatgtctttattttttaaaataacgattaagtgctttttttggcttattaatatgattcccttaagaaattttattaggttgtataagtgtgggtcactgtataaacttcaaaattatataagatgacatctttaaattcatattttctcctaattcagagagaccttcttagttaattggaatcagcaaggtttcaccatagttatcttttactgcacttgactctgcccaggatcccaatgacctacatgaaaatttggaaacaatcccccattaggtaagtagagtcagggaaaatggtttcaatctatactctgctaatcatttgtaagactctggctgatcttcaaatcccttctcttaagagcttcatatataaaataaagggcatttttcattctctagcaatgcacattcaaaggtgcattcacaacgatgttcagtgcaatattgttggtagaaaagagaactggaaacaactggaaattctaaaaaactgtggggcagccaacctacaaagctaggttaaaaggaatgagctatctctacaggtaacaacatagtctttaaaacataatgttcagtaaaatgccacactgcagaatggcaggcacagcaggagacaggtgttccacacactcaaacacatgtgtggcttttgccttccatgaacgtccacatcaaatggataatggggatatgttcaatagtggcaaggaggggcaaggatcagagggactcatttaaggagactttagccttatttagaattcttttttaagaccagcattttcacatatcactgatgcaataaaatactaattcaaaaataaatattaattaattaatggccccttcattgttaactacacaaagccaaccagtctgaaggatatgggggtaaccagttgaggtctgtttcctctgaggaagtagtccatggaatattccagaagatcccagctcaactgacacaacaaaccgtatattacaacaaataagaaaacctttgtttaaagaggcatttgttcctctttgccggctagttgctgaaaaccttcattttaaaaagccacaccttttacagcagcccaaaagcaggttacgaccacaaattaatatttaaatagtcaaaatcaagagactccacttgattgctttttaaaaaaagaactcaaagatttgttttaggcccacatggtcattaaatcttaaaatctaatacatatgaatgctggaaaaaccttactagtttataatttattttagcccaaactattcagatggattgaaaacagctgggagacctaacagaaaagactcaaaaggtcactgcttgccaagacagaatgctccaagacctatcaaaggagatagcgagtatgtaactggttaactgcagacatatccctaccagccaggccataggaagcaacatcatcccatacttcatggcataccagtggtcttccctagacaagcaaacactttgtatgccttgtggcagcaggaagtctgtgttctacaaatcatgtcacatatcacatataaggcatacatataaggcatacggcacctgtcttaatgggcttgtctggtccattcagggtaaggaaggggaactctcagaagaggcagaagaaagagtttatggatggcagcatccgctcttagggccttagaaggcagcaaatattacttctaagggatcccagaaaactattccagggaagtgtatgttcaaagtgtgatctgcaggagcgagaaaagcttgggacttgagtatctaaagttctctattaaaatggtgtcattttggaaaaaacgaatggcaaattctttgctagtgactgggacctgaccaactaatgtaaggaggagaaatctgttttcctctaaatatcaaggccataaactataactaaatggcagaatgtcatagttggtgaaattttataatgcttgtacacaaataatttatatgaaaaaagtaaagctgtaacagaatacataccattttgcaaagaaaggctagaaggttatgtgcgaaaacagtattttctttggctcatgggattatgcgtggctttattaactatttttagtatctctacatcaagaaaagctttatttatttataaatacacacatacatatccacagataccacaataaacaaaactctatactgcttctttttttttttggacagagtctccttctgttgcccaggctggagtacaatggtgtgatcttgcctcactgcaacctccgcctcccgggttcaagcaattctcctgcctcagcctcctgagtagctgggattacaggtgcacgtcaccatgcctggctaatttttgtatttttagtagagacggggtttcaccatgttggtaaggctgctctcaaactcctgacctcatgatccacccacctcagcctcccaacgtgctgggattacagatgcacgtcaccacgcctggctagtttttctatttttagtagagatggggtttcaccatgttggtaaggctgctctcgaactcctgacctcatgatccacccacctcagcctcccaaagtgctgggattacaggcgtgagccgccacgcccggcctctatactgctttttaagataaatgcagcatatttcagaacattttgttgcattttaaaatcccttgagcatcattgatctctatatcctccaagagttgcttacttttccccaaaatgaatgcatacatatagttttattaaagaaccctcatagattaggacctgtgcttgtcctactgattaaatgtaaatacggaagaagtaggagagctcagctgggctgttggggaaaccaagcagaagccgagcattgccatttcagcactgagacaaacaaaacctgagttgctgggaaagagagtggacctctctggacctaatttcctccaggtttaaaggaagtgggaatgccaaccaacctcactaactgaatgaatcaagaaaaactgcacaaagaggctttgaaagggtgaatcctaaagtgtctgtcacatacaaaatggatctacgcataagaaaaatgtactatttttgtcatcaatttacattttttcattgtgatattcattcccctctgcatttgggtctcccgacttcagcattttagtggaaacattttgctttcctcctaagcattccaacaaatgctgtgtcactaatccacatgtcactgaacacatgggataccttacagtttcgcaaggcaaatgttgcaataaaaactgaaaaactgtcctggagttggattaggtaatacagtgtgcaaggggcagggaactgtgtgtgtgtatatatatgtatacacacatacacacacagttatagatctctctctctctatatatatatatcgagggggagagagacagagagagtaggagctagagagggagtcatcagggaccactgaaagccactgaaagaaaatgactgtgaggtcttggtcaagggctggtcttagataccaaagaagataaaagtacttctgagcacaatctcagaccacatgagccttctctgttattcgaaaacctatcaatgcataattctaaatgtaggactttaaatttacaattaattttaactcagtaaactgatcattaggagtttgtattaaggaaataatcagtcttgcaaaaattcctataaaaagatggtcgacacagcactattttaagatgataaaaaatggaaacaggcagggcgcggaggctcattcctgtaatcccagcactttgggaggctgaggcaagtggatcacctgaggtcaagagtttgagaccagcctggccaacatggcgaaaccctatctctactaaaaatacaaaaattagctgggtgtggtggcaggtacctgtaatcccagctactcgggaggctgagacaggagaatcacttgaacctgggaggcggaggctgcagtgagccaagatcacaccactgcactccagcttgggcgacagagtgagactccgtctcaaaaaaaaaaaaaaaaggaaacaatctgaacttccaagagcggaggactgagtagagagatgtgttatatcaatacgatgaaaaattatgaaaccattaaaaatgagcacaacaaagaatattcagtgattgggggaaataataatgatataagacatgaacagcagggtaaaaactgtgcatagaatatataaactcattgttaaaaagtggatatacatatatattcacacacatcatatacccaaagactaaaggaaatgcactaaaatatttttctaaacactaggattaataagtaattcatattcttattttcagtattttcaaagattgctggattttacacataatgtggcaataatcatcaacaggatcagtactgcagccaatatgtagcatgcctggacaatggcacatactggccttagcgcagtgctagattaaaaaacaactggagtttgttctatctctcctttggctcaatgacttactaccattctactcaagtgtttatgctcctaaattactgggtcatggccttgattgaaaaatgtgacacaaagctgttatagcccctctcaagcaaagctgcacagaagcacataattttgcatataatttcagggagtctttgaaaccttcactagtgaccctcagaaacccactctattggggcctatagtccttaagttaaatcatccttgtccaagtatatggctatagcattagaagcaattcctagggtgagatttactttagcttagcttttattttcagtaagagcagcatataagtagaggggccaatgggaaggatcaaacagaaaggtaaaacttgcattgcttacttcgccttctttcttggaaagatttaaaagacacatctgaaaaaattatgaggagaggaactgtattaaagaacacaggtaattttcagcaaaagtgctgctccctggtaaaaggaatgtgcctcctaggccatgcttttatttgttgggggtagtaggttgatgagtcaaaacagtaagagattatcgaggcaaagtcacaatggggtgcaggaaagacaaattgagaacaatctgagacttccccagccaatcagaattgatgattatttgactgcaatccagtggttctaaacaatgaacatcaatggccggcaacccttctaaaaaaaagccatctgcatcatttcctgccaaccagttttttgttttctttgtttaatagagaatatataagccatgaaataaatttaaactgttctctctgtaccaataaaaagctaacgacagtccagaaaacaggaaaaggtacattcagccttcacagtttccactgagggtaggaaggaaaacagggaaaattcactcactcatgtaaccaaactgtgctgacagcctaggaactggcatgaaataaagcaatgggcaagacctacagggtcctgctttcacagcgctcacattctgtggggagacagaataaacaacttagcaaacaatttcagagagtggtaacttctgtgatgaaaatgacgcaggacaatggaacaggctgtgccggggatgcacaactactttatgttgggtgatcatgcaagcctttcttgaagagaccgtatttgagctaagagctgaagtatgagaaggaaccagtcatgagaccattcattcatacaagatttattgagctctgccatatgcctagcaaagcatcactaagagataaaagtaaatcagacatggcccctgccctggaggagctcatagtctattttaaaagagaaaaagcaaagcaaccgttttataattcacagtggtaagtgttacatgccaggagagaagggagcactgttgctttcaggaatacagggaagagaaatctaatccgatatgaagaagggggcagagggaggagctgaagtgaagaatggctagcatttaatcgtggggtgggggagtgggtggaagcacatgcaatgattgatgcttgagtgaataatgatgataagcttttcttgttgttgttttgttttagctaaatcagtgtaccagcataaactcaaggccaagctgaaaccagagtacattttcactgaaggactttataaacactatatatcacaaaattgaatccataaaaaggaatgaaaaaacgatcccagtttgaacatgtttcattttttttttctccttcttctggctaaataccatcataaccccgtagcataatttttcaatacaaatatgataccagctgccaagaacataagtatcagacccaatgtctccaaaaagatgaagacattctttcctttggggacttaataatggtcattatgaagtattttgaccatcataatttagagagatagttggacttcagatgtctgaaataagtagctcccaaggcagtgtcagctggcattttgtgaagaagattaagaacatagttgtactggttttacagctacagagaagtctgcttcaattacacagtacacatagtctaataaatatgtcccagtagaaataaatggcttgcaaagctggtgattcctgatggcttacagagcctttcacctcaaagtcacaagccttgacctggcacaggtaagaaagacctaaagtcataaataccttggactgctcaaagacctgggtaagatggatgaattgtctccatgcaattcctgagaaataaatggtcactccagagaaggtgtcattgaaatgatatggatgatcctattgttgctactcttgaaaacatgtgaagtatgcctaaaggttgaaagcttagtgcaaaaataactaaaaagtattcagagcctgtctttgacataaatttattcttcgtacctgcactctaagtactaatatcttctcattctgcagaagagaaaaccaagacactgatggtcaagtaacatggccaatgtcacacagtcaggtgaatagctggggatacttggtctaaaaccaagcctgtgcttttaaactatatgctgtcattcaaaggttccttaattattttggtttagagtctactacgataagattaatcctatagccattcatacataccaaatgcatttacagaaaatttttaatatagctttatgaaatacatggacctaccactgacaactgctaggtcaacggggtcaaggtatctagggctcataactgcgacatgcatttgggaagacagttcttttctacagatagccgaagagtgtatgcacagtcaatcaatttcttaacacatccctgatattttactccaagtctcagtacctaaatcactggtcattcaaggctacacatgctaaaaatacaacgagatcagtctctgatttgggacaatgaagcatgtctttaaagctacacaactaacaggttgactggccacaaaaactcagtttcaaagtgggcaggagctttttctagcttgcaaatgtttcctgacgctacctaataacaaaatttcttttttattaatgggcttagagaaaagatatggaatgagtcagaagtggagtgaactatggcatcttctctccagaaaggaaagaaaaagaaccgttaacttaaaacaaccactaatttgtcaagatgtacctaccacgaggtcaatctttctaccctaggtaatattcctaccaagatctactttttaagggtagaattaagctagtttctcatatggttctaggaaagctctctaactttatgtaagttaaaaatatttgtaattgtggcatttagaagtcgggtcttgtcttcatctaaaaatgcttctacctctaaggaagactccttaactaccataccgacaacttgaggcttctagtacctatatttcaaatttgaattgctttttatgcaaatacttaagggttgaccatgtaacccattcctcttatcaacagctcattcacagaggtctccctaagataggtgaaactatggtggcctgatagccccatgcagttcctacaaatttgagagggtgatttttaactacataggatgtacggggggattatgaaacaatagctcaaaatagctcaccaaaagaaaacactgataaggattccttttctgggttggaaaaacaggatgctgtgtgggcccttattttaaggtcaccggccccaaaggaaaacctatcactgtaattggtgctgagaagcttgtaggttaaaaaatacacgctggggcccttttcttttgcattgctgacttttaggttgtttcttatcccaactgcttatttttagtaatgtaagttaggctcaggaccaagatagaaacccagaataatatccgggcttttaaccttataggacaccaaacccctgaaacctaagaccctgcctgaggcttctttttctctctcccaccatatccgtctccaaacgcattctgaatccatccaagttcatctccactgccactaccttctcttgcctagatgaccacatgagtccagaaactggtctctgctttatggtttatcctctttattatccgcaccgaggccagagacaactttaaacggcagaaatcagattgtactgtctcctggctccatgtccctatggcttcccaaaaccatttcaattaaagacaaactctttgttcagtgtcccactaagccctcctggatgtgacccctcctatctctttacttcctcctcctggacacacactccagccaggttggcaccctccactgcggaactgcctccttgcaattctctgggcattttctctggctgctccctctgcctggaactctatgcctgcagatctatgtgtgggtggctcctgcctttcactcaggaccctcctcaaaggtgactccttcagagagccaaccagagatccaggcaggctaccagcagatctgaagtggcccttttctgacccactttattcacacaacccagtgtctttgttttcattgagcctatcactctctaaaatgaccttgtttacttgtctattatttatattgtttattgtttacttattgattgtctctatttcagggacctattctattttatcggtctatccctagaacagtatctggtcaacagttcaataaacacctgtatctctcaaatgcatgtatgaatgtgcagagctcatgaaatgagtttacaccttgaaagctgcaggaagagctgatgaggcaaaggggaggagctgcttggcctttctttttatagccatcattgctgcagtgactgtttaacagctcttgatccttggtctgttccttgatttattggtgagctgccaggttcggctcaactcacaactgcctcactcagcacagagaacaaggttccgctgtgccacctggtgtcctgacttcccatcaccacagatgagctttggtctcagaacaaactgaaagctcagagggaaacaccaaaccctataagctccccactccagcaaatggatatgttctcaaggattctttgagatctaaatcttcaggtaaggatagcttcatatccttacttactaaagcaaacttttattacagcactgggttcaatgcctctcaatgcctcactcttccctacaaaaagcgaacacatgctgatgaaaaaaaatctcagatccttttcttagggcaaatccatgaatctcttgagcagtttcaacagactgattgatgtgatggtcactttttgtcacaagatacttctgcaaaataggaaaattttccagcttgctctggaggggggtacattgtttggcaatttcaattagctttattcccaaactgcttaattgcaacagaggccatgcctggtaccatatcaagctttactccaatatcttaaatttaagaaatcatataagccttagaaaacacaggtcatggttaacaacagcaaggcgatcgggcttcaagtcctgccgcactgcattattcaaagtgtctgcaagtcagacctaaagaagtcatttactgaggggtcaggttttccaaagagcatggacatacagtgagcagccccattcatctcccatggagatattaaatgtcttcaaaatcctcttgctgaaagagtatctgaactggtctaagtgattatgtgacttagagggaaaaaagctgtttccttgactatgtcaatttctaatgaattgctgccccatatagctatgaagggcaggagacgcttgggctttgttcagctattagatttcaggtttcggtgaggcagtgctcactgtaccaattggatttgcttaaaggctgagtacaggaatcagtttcacccacatacaccccaacccacacactatcccagttaggacaagcctcaattagaagtaacttttataggtccagtacattggagatgcaggaaaatgcaagaactgtgaggccgtttaatgaaatattttagttgggaacaagatgtgtaacaaagcattgcatttatggcagggaagagtaagtacaatggaaacgaaatacatgctgacccagtaagcactcaagtcaacaactttctcactgtggaaaataaatgccaagatccttttgctttctctcttgtctgattctggctatttcctactgtttatttatttcttggtaaatgaagctctaatcaggctttgagtcaatgcagatggtgatcttaatgcaagcaaacacaacttgaaaggaatttttgaaagctgtcataaagtttctgagactgctttttacatacaagaaaccagctatggatattttggggtgccctcgagcacactaaaggtgctcggttcaccccatttttgtcttgcttttggatttcacttctctgggttaccccgataacttatataggacaaaagagtttcataaaagggcgtgactaatagatgttatagatgttgcgttacataagagtgacgaatataaccccggccttgaatccgaacgctttcttcctgaatgaagatctaggggaagcaatgatcaaagaaagaggggagctcccatttgctcttcccgaggtttggatgccagagccccactcacacattacttcggcagctctgctttcgtatcctgttctattctcaacctcctgtgggcctttccctagagcagtgattcctggattttacatttcataagccagcagattttgaaaacatagaactgagcaattgatcctaagttgccaattctttcttttgtgaactaagaacattaaaaaggaggagataaatgataacaaccttttcataagaaaaaaaagaggcactgggtgtggtggttcacgcctgtaatcccagtaccttgggaggccgaggcaggcagatcacctgaccagccagatcaacatggagaaaccccgtctctactaaaaaaaaaaaaaaaaatacaaaattagccgggtgtggtggtgcatgcctgcaatcccagctactcgggaggctgaggcaagataatcgcttgaacccgggaggcagaggttgtggtgagccgagatcatgccattgcactccagcctgggaaaaaaaaaaaaacaaaaaaaaaaaaaacagaagaagaagaacatcattacctataaagaagaatctttcatattggaaaatcttcacttcatgaaaaacctactactccatcctggtttttctcattattgtttactgaaggaacgtgctgtcacagaccaaaaggaacacatctcctaccacctttccttccaggctcttccttttcaccttccctaaccttttctctactccagacaactaagtcaaaggtactgaaaacaggaggtctgcttcagcctctcctccacctcttttctcttaagctccattcaatatgacagagcaaggggccagaaaataagaaactcttcatcagaacagggcagcgctgaaggtgtaacaggccctcttcttattccatcgtcatgacagtgctgagaagggtgcagtcctacccatacttcagatgataatctggaggctcatggacacagcccagggctggctcaggctgcactgctgggtgacagcagagatcacgctggagaccctcacagctgactacactgccactccgttactgaggagatgcagaggcaacactaagaagaagtggggaattctccaataaaatttcttcaatccatattcaacaaaaaataacccagaagtggatttcatttgtacctaaacaaacagaacacagagtttctaagaagcaaaaccaaatgggtgttgaaggggttaaagcagtggttctcaagcacatctaattttgctctttaaaggacatttggccctgtctgaagacattattggttgttaaaactggggagacgggggtgctaccggcagctagtgctaggttataaaacagccttctcttcctcctttagttaccaaagtctacgtgaaagttgatttgcagatgcagacaaactatataaacatagaatcccattaattcatgggcagtgctgttattttttcaatgcaatcatctgccattttggtaagtggtctctatggcaaaagtaactacacagaatgcaagccatttttaaatttagaaaaaacaaaaatacctaagagcgtgtagacctaattccaactatttccaagcgatttttgaaaacaaattcatgtttatgtaactataagaaagctttttaaaacatagcttttacacaggttcatcatgccaagaccccttttgcataccgattgcaaaaataaaagcctaattaaaaactcaggttgctgaatgagtggagtcaacagccaatgctagggaaagaaagggattccctccatcacaaagtcatagctggtccatgttgcagcttcatagttattatgactgctattctatgacacagtggaaaaggacctttaaacaaccttgcaacaaatacaaagatcacaaaaagggtctattagaatttttcatggcaaaggtaatacaccaaatgagatttctagaaaaagcattaggcatgagacaatggggaagctgtgattaaccacactgtatttttgatgtttccttcacggcactcctctataatgagagaatagcacggtgctaaagtttgttgaatgaatgaatgaatgaatgacacttattgcatatggtgaggaaccaaaaatgttgagaacattagaaatgcaaaaaggaacactattaacaagagtctgaaataagcccaggtaacaacttggcaaacaataaagggcattttccacgttgccagtggaatcatattactcctaagggctccaggctatttttgaagacattaagattctacctgcaagatgtttgaaccaaaaaggattatgttcacaaataggggacatgattaatatttaagcagaaatacaaacaaaggaaataccaggtaaggtagaagttttaactttacaggtgacactgcaaagacagactcagtaagcaccatggcaaatacttccctccagatggtggtaaagaacgtgtgatttcatttgagggaaatgaaggaaggtgggaacattttacacatggtaaactctgtctcagataacggtttcgaaaatgctcagaactgaaaaatgcttccgatagaagtaggatgatatctcttgcaataaagagaagttcaacaaagtgaggctgcaagcacacactggggcctgtcggagggcggcaggggtagtgacagcatcaggaagaatagctaatgaatgctaggcttaatacttaggtgatgggatgatctgcagcaaaccaccatggcacacatttacctatggaacaaatctgcacatcctgcacatgtacccctgaacttaaagttgggaaaaaaagactgatataatggaggatgctaatcataataatattcctcatagcaaagacttttcaaatgggaaacattatccaaagttgctgacaactaatcaactaattttcacatggaaccaaagtaagggtaggaaacaaactccaaagttaaggggggaaatgtctgatgatatatggtttcttttttttttttaaagcataaattaaaccaaaaagaaaagaaaagttgccagttactgggattttgagatgatggtgaaaagaaagtcctaggaaatggatccacaacaggcctgcacattcatgtatgatatcattgcctttcttgatgtttttgtgtatgctgtctttgggtctcaaactcaggtgatttgtgggccacaggcacacaatgggcaagagtaaggacagatgtaagaaacagcaggccagggggaagctggaattgttggctccagctaaatgcattcagatctgaaaatattttttttaagactgattaaaaaatacatgatgagtcatgtcaaatactgcccatggaccagttggtaactttaaatccttcctatatttcaaagcactgctttagtccagctgttcttagcagagggcgattttgccccttaggggacatctgtcattgtctggagatgtttttgactgtcaccgttggagaaagggggcaggtatgtgacaggtacctactcagtagagaccagggatgctgttaaacatcctacaatgcacaggaggagttcccgcaacagataactgtctggcccaaaatgacaaactgtggaggctggggcactctgctccagttccagcagactgttgtccatcctccgtaccccaccattcacctattatccaaatatgtatggcacagactcagactacatattactgacggtaaagctcacttgttagtcttgcctccctaactagattgtgagtactattttctccttatttcagaactgtgcacaaacaatatcctcagtccttcatgaagaacaagaatgggtcaaatggaaagaggcttgtggctattactactaggactatgaaattaaataggaaagcctcaaataaatagaaatttcaatagtttgcttttagagggaaaaagaatgatcaaatctagttccatcttctgcacagtttacacagactaaccccaaggcctaccccttctcacctatgttgcatcccatcttcttccccttcttaaatacttcactcctgcaaagagggagtgcaatgaatcctcctttctcctccaatcattactttcttcctgtcttttgagtcatccctatccatacacaagaacgctgtggtatctctcatcttcaaaacaaaacaaagccctctcctttgactccacacccgtctccaggacttgttccactgcacagcagatcttctcgaacagcttaccccaatccctatcccacctcctcccctctccagcctctccagcccgactgcattagtagccacacttcatgggtcctgccctcaggggacgttatgccacaggcagtgttttcacccctgcaggcctccacctcttgacccatgagtgctgctacaatggtcttgtgacactgtcttctcttgggttctgtgatacaacgctttcctgttctttcttctatctgcgctggcggctccatctttactggggcctcctgctcagtctgacccttgaatggtgatgtgcctcagggttctgtcttgcactttttctccctccttcctgctctttccctcagtaatctcattcagccccatggctctaaataacctctgattctatcttttacaaacttatgtgactatgttccacaatgggaaatacattttataacacattcatacacacacacacacacacacacacaagtgtatgaatgtgttacaaattgtatttcccattttatgaaatgtgtgtgtgtgtgtatgcatgtatgcatgcgtgggtatacacacacagtaaatatttcataaaaaaggacttatcttcagtgagtgtgatacactctaatgttttctgtttcacttccaagaaaaacactgggtgtagcccaatacattgatttcacagcccagtaataggtcacagcccacagtttatagaatactcattgagacaataatggctcataaatgcgtatttttcctgacctaacctcacaaccaccaaaccccagattccagacaactgcctacatttctgtttcatttggatgtcaaatgggctttcacaattaacaagtgtgagaagaaacccttgattttacagctcaagtcctacctgtttctaccctaggatccacatctcagcaaagattcctcccaggtcaaaaattctggggtcattttggctccctcccttttcctttccttcagttggggtcagcaaatacagcccatgggacacatacagttttcttggaacacaaccaacccgttcctttacatatcgcctgctacaagggcagagtagagtagtggggacagagactgtagggcccacaaagcctaacatgtctaccctttgtctctttatagaaaaagtgtgtccccccactttacagtcaacctgtggagtcctgctgactattctttaggtgtcccaagtcccccactgccgtgatcctctgtctgccctacagtccaagttgctaacactcttgcttgaactactgcaaaagccctcacaggtctccccttcccctcctgttcccctaaaatacattcttcatatatatgccacagggactatctgaacacgttactgagagcctgtcccttcaccgtgtgaatctggacctcacactgcaaatggaattcgaactccaggtcctggcctccagtctctgacttcagccatccccatcccctgctcccctttctccaggcacacaggtctctgttccaattctttcttagggtctttgcactaactgtcccttcctgctggaataccgtttccttctctgtggtcactcaagtttcacctctaatctacaagagccccctcactgccaggcctgccacacctgttcactttacctgctctgatttgcttcacagcacttttctttggctggcatgattttgttcatttgtttatttttgccctttctccccttcccctagaataaatgcctcatgaaatcaggagcctgtttgtttcatttgcagatgacgctgctctattcccagtgcctagacgatgacaggcacgtgatgttaatgaatttgtcccccaaaaagagacaacaaagcaacttctttatattcaaattccacacttaaataaaagcacagaacaataattctacagcctgccagccaagggaatgaaattctaccactcttccagaaaggggaagggatgacaccacaccttaatgagaactataaatcacacacgaacacatttgtaataaataatgcatataagtaagtaactcaatgcattaagtttaccttcaaggagaatgagacattgctttgtagaacaaaagtaaaagttttaggtgtgccaaccactttgcattgtgaatataacagaaataaaactcaaatcatccaataaagtctgagttgcatacaaatgttaaataagtaaagcttgcttaagtttaaaaaccatgagatcaaaaatccgtaaagaaaccagaattccttaagatgtgaaagtgaggaataatttttaagcattatataatgaaagacagaatcaaaatagaaacatttttatatttatctcatctcttgctgtaagtcatctcaaatataaatgtgacctgtcactctacaaagaattctcaaataaaatccctgataactttaaaccatggcaataaatcaaaatagcaacttaaaactgcattatgaataaaggccagaaggctcctttaataccaaattggaatgccatcctgtttagcatggtggaagtgctagaaaatttgctaattttaacttgaacaacttttaacagctagaagatgttaggcagcacgttggatgtgacaagaggactcaacttacaaaattattagaaaatacaagcaccacagatagtggtgagtgaggtcaatgagtttgagatactgaatcaatgaatcagataaatacaccaaggagacttcaaagtctcccctttaaaacagacttctgacaaattgtaacttgctgatagctcatatggcagattatacatatttgatatataaaaattttagttgagtttttctcgtgttttgaggtttcttccattttttagattaaaggtactttaatgaaataatttaatttaagctccttaaataacatcagtctagtataaaagctgagatgcttcccagccaggtggaggtcctgtaacccgcttataaacttgatgacaccatgccaggattgagaaagtggagattgcccccaagcacttatactttacaagtcttaaatcctctgagtgtgaattccttgcatcccctaacatccagttaacacatataaagaactcagagcagttactaaacatggaaatgatgtaataaacaggacctatgtttatcactctctgcataaaaataaatccattaactatgcacgtgccttcaatttcatatttttcttctattcaaatgtataaaaacaaaagaaagggtaaaataaaggatatccagcttctcacttctgagggtgcaataattaaaatctctagaactgtgctgcgtaacagtacttcctgcaatggtggaaatgttctctgtctacactgtcctatatcgtagccactcgccacatgtggctatggagctcttgaagtgcggacagatggactgagaaactgaaatttaaatcttacataattttaatcatgagatagtggctacttgacaagatgctggagaacaggctttggaaccaacatgattcactgacatgaagctcccacatcttggcctatggacacaatgaacaatgcatctactagctgtttagggcagcctgtgaacagagcacacagctatggcaaacaaacagacccgggttcagagtcaggatctgtcactttttagctgtgtgactggggggtggtcagtctattataatgctcacaacctcagaaagttctctcaggattagcacttatgaaatcaaagggtcctgcattaactcatcttttcattcaatgcagatgattttctgaatacctataatggactaggcaccattttaggcagcagggataaagtagtgattgcaaccaagtcccttatctgagggggatcacaggtaggtatagtacataagaaagatcacgagaacagacagtgatcgtgggagatgctgcttgatttatgaggaatggtcacggcagactcctcagatgaaaggggatgaaataacctccgagccgaggcctgaaagatgtgagtgaggaggtcctgtggctacctgggagaagaaaaatacagacagaaggagatgtaagtgctagggccctgacacaggactttggagttcacgcttaatgatgggaagctattctgacatgaggaactgccttgatctgatgtactttaaagcactgtagctggagggcagactggaggaagcactgagacctgttgcgaggccactgcaaggccaggtgccctacaatgggtggtaaaggccagggatggggtgagatgtaaaccaagtttgagtacactgagaagggagaactggcagtatttgctgatgggaacatataggaccccaacattattaagatatcactctatacacaacctgaattcccctttctggggccctacagctcaatctgagacattgtggcagtcaagcacttaagcagtacaatgtacaattcattctctggtccaagaccagagggcaaagaggagaagtgcctgatcacttgggtttaactctctgtgcatggcttaccgtggttctaattatgatggttttgtatcatttcagaaaaacacacgtgcgtgcacacacgcgcacacacacacacacagagaagagctaatgctaatgatgcacttagctaacgagattagatactgctttctctgtttggatcaatgacgatttaatgaactaaatatcatcagtaaattttgatgagaattaagaggcattactttgcccacagacttcaggctttactcatttctttatgcataagatatagtcttcaataattatggtactggagcaatttcttgcctgtaaggcaggaggcttttgggcagagtgtttaagcactgtctggagccagtcttcctaggttccaatcctagctttgccactaaccagctaatttgggtaaaccacagaaactccctgggcctcagcttcctcttctccaaaatggagctaagactgtatttacttcagaggactcttatgaattatgatatgtaaaatgtctagaagcatgcctggcacactgtagaagcatttattgttttcattccaaatcttatgcaggttttcccaactaaaacagaattttctcctttgctttatactaatttataccaaattaagctgtgggaaaacaaaaacaactccttcttgtattttgtcctagcatagaagctaacaatcactgccttcatttcacaaggatccaacccatcatcacattgcaaattggtggcagtttcaatgtggttgcaacaatgaagtcttgaaaggttttatttaccttcttgggcatgtgtgtgtgcatgaatgtatgtatgtgtattgcatgtatcatggtaacacagcttgaacatagtaagtactcaggaaatgacagtagtgacattatcattaccatcaccaccaccattttcttatctaagttttgccttttaactctcattatcatttttctagagttacaaagtgtgcttataaagctagaggattaatcttccattgtgactggtggatcaagtttaatttattcagctatgacttactgagaccttatcacttgccaggttccccaggaagtgccagagacacaagagtaagagtcaaacacattactgctctctaggaattttaacatttcatgaatgtataatcagaccctgaaattatttagcggcctgaccaaagtattcagtatatggtctgtgcaaactagaaaggacaatttcacttccattactgttgtgatcagcaaaagccagtgggagatggcactctaaatgagcatctccaatagcaagtcccctttctattctccttggaagtagaaaaatgtagaatgtgggagctgaaatggaccttagggaagactgaaaagtctgtcacttacaaaacagactttaaaagttgaacattactcagaaacgaaaatattaaaataagctttataaacttattttcatccaacttataggtcaaagaatcaaaactagaagggaccgtagaggcagaagcctaacattttttgcaactctggttgtatatcagaatcaccagtggtacctgggcaacacagtgagaccctgtctctacaaaacaattttttaaaagagattagcctcacaagatggcacatgcctgtagtcctagctattcaggaggctaaggcaggaggttcatttaagcccaggagtttgaggttgtgatgggccatgatcatgcactccagcctgggcaaaagagcaggaccctgtatcaagagaagaagaaaaaaaaaacctaccagtagaacttctaaaaaaaaaaaaaaaaaaaaaaaacaaaaaaaaacacacatgcctaaacatcatacaatctgtacggcccagctagaactttttataaaaaataaaatattaatgcttccccacccaattgccactattgctttatcatgtgatgactactacgtcaggaattggcacaaatgctaccttatttaatctatgtacatcatgcccatttttttcagaagtctaactaagctcagagaaggcaagtgacttgcctaaagtcacaatgcaagtagagcagaagccaggatttaaacttgcatcctctgtctccacagtcctgtggtctttcctctatacaacaataaggtcatcccttgcataaaatttgagccagaatggagtgcctgaaagattctctagctcaaaacattcatcttttagattaaaaaaataagtgtcagggtagaagtagtacccttctgaagcatatgcagaagcttacgggcagagtttgtactcaaggtcagctcctggtatcccaagttcagttttctttttaatacatgccttctctcaaaagtaaaacataggatcttcacttgcatacagtgctgccaaatcttttcttgaaacggagtgttgtgactcaacatgaaattacattttaaagagtgtcacacctactgataggtgtgaatttgccgaatatccaaaatatttgacacagaggggcacaggtagttacgctatctacatgagccttttttaaaaaaagtaaaaaatccttatgggacaagttcgatagcttttacaaattaaaaataaaaatccacaaactagtttgattttccaaacacttcaaagaagtctctagatgcacactgatgtcaggtgacaggatttctgaatgcagatgctatgttcaaaatagaagggtaaaaagcactttcctgactggacagcagagggagaaggagtaaggacacacaattggaagaggggagccagacacagagaagaactgccctttaaaaacctgagtgatcgactggcaagcagggagatgttgatgaagaggagatttgtaagcaaatcaggactggtcccggctacttgggagtatggatgaacactgcacagcagctctaagcctgactcaggaaactgtctgaccctggacatttacaaatgatatttcaaccttcagctcgatttccagatgagggaagggggatggactaaaactactaaaaatgaaatgtattagatcttgacaagaacaaatgtcaaaaacgagctctagagatgaggaattaaaatgggtgctacaaacatagcagccagttctgtcccaaagtaaaaatggcccgttctttaaagcatagaaagccacaacctcacgacaggaattcctgagactcatggaacagtgtagatgagtttatcagtcatcttactagcagttacaaaataaactagattcattagaaagaatcggtaaagtgggcatttactttctcattgaacctagctgttgtcttgaagcaccttcatcaagccttctcattacatccccactatacagaagagatgattaaatgtcagccctgattcaagcaactaatgtatggcagaaacagatatatttatatgccttccagaaagattaatagtatctagtgctagcctgccaactgcagatgtacaaactttctatcctatacataaatcatacacaagacatatggtgtattttaaagactgctgatgtcacagtgattttaaattactcatgttctgaaataaaccatgtagatgttgatgaatatggcaatatattccggatttttcatataaatgttataaaatgtaacaccattaatgagaagatggcattgggaattaagaagagagaatgcaaacatatttaaaatcaaggagtatagtcaggtgtggtggctcatgcctgtaatcctagcacttcgggaggccgaggcaggtggatcccttgagcgcgggagttcgagaccagcatgggtaacatggagaaatcatttctactgaaaatacaaaaatcagccgggagtggtggcatgcacctatagtctcagctacttggggggctaaggcaggaagatcgcttgaaactaggaggttgaggctgcagtgagctgagatggcaccactgcactccagcctgggtgacaaagtgagaccctgtctcaaaaataaaaataaaaaataaaatcaaggagtacgtttctataatcagttgtttgctggcttaggcgaattcattacaatatggttctaatacatgtgtaagttagttggctataatgaaactttatgtttggtctccttagaagtgaatctaatgggataataaaccacatcaataacagaaatgagaaagaggatagatgagttaggagaacaaggtggtttgtgtctgtcaaatgagcagtggctgaatcagaggtgcacctgatgtaccaagaattatttgaaagtttccaggctgtcagcctcagtattaagcaactatacaaaaatcagtgttattcagttaagtagggcagaacattggactggaaaccacagagccagggtgaacagctcagaactactgtggggtggcaccttcctacctcacagggaagtgacaaatatcagtggagaggcacgtgcaggtatgaaagtgctttgtgtatcactgattcttctataagtgccaggtttcatcatcaccatcatcattattgtcataatcgttcttatacccaagtcatttcctactacatacatcttggctactgtttaaaaccagttctctgagcagtcaagtgatctaggtacaagaagagacttgaaaattagttggtggaaatgacattttaaaaaaaataaaatttgcacaatgccttttataactgcctaagccaggctcattgagcatttcaattcacatagacagctactctgtattttgggtttccttcaaatgaccccagccattctgatcgcagaacacacaggttcatgaaaacatgagaatctggctgctgtgacacaaatgagctctcctgttgcaacaaaccaaaaggaagtcaaagtctggttcttgatctcttttcaaaaggcctgaatatgttgttcatgaaacaaatcatggtagcaaggatcagggaaacagccattctcaggcccactgtgtaaaactatcagtcacgactaatcacatataagtatatattccaggagcaagacacttcaatatggtggaaagtattgctcagtgtgacgtcctgtgttttctggtgaggcagagggtgggatacggactcaaggagaaaggaggaagcttaatgcctcgagatttagaataacccagatctctgagatcctaaactactaaacgcgagcatgtggagggaagtgtttaatatgattagcagacctcttgtttctgccaaatagaaataatcacatacctattcacttaatacctattcattcataaatacctaaaaggagtcaggtgttgtgttaaatgctggggataacagctgtccacatgcacacatgggccctggctttatggagctttatattctaatgaaagacaaataatgaaaaataaataaaagcatgaaataacgtcttgtgctaaaaaggtgatgatgatcaaggttatgaaaaactgtgataaagattatatggaagtgttgggagctactttagataaagtgatgggagaagccctctctcataaggagacctgaatgggactgagccagctgggaagagctgggaaaggaccattccaggcagaacggacagtaaatacaaagggcctgaggcaagaaaaggcttgaagcattaaaggagctccataaaagcagccagtgtggctaaagcaccatcagatggaggagaggaacatgagacaagtttggagtgaccatagccacattttgcaggctatgcaggccaagttcaggagatttaaaggataaaggttattattttttatatatatataaaaaaactttttagagaatggggtctcaatatgttgcccagtctggactcaaatgcctgggctcaagtgatcttcctgcctcagcctctcaagcagccaggactacaggtgggtaccaccacacccaacttaggtttttaaatcttaacattttaaaaaggcaaaatctgatttctgttttaaggtatcattctaactgcatatgtctgtcataatgtataaaccacaatttttatgctaaagaggttagtatttggagaaatcagtaggcattttgaaacatttaaataaatttaaaaagcccccagtggtcatctgaagatgagtaagttaagcaatgaatttgggataaaaaaaaaattcaaagaacaaaacaaccctacttacctcctcgttgcaccaacaatgtgacctcacttcccttaggacactcaaccagcatatccaccacttggttgtgagttagggcctgcacgttcttcttattaacttccactatgagatccccttctttcaggcctcggcaccttgggctgtcaacaatctgtttcactctttggccacccccaccaggactgtctgcgatagtaaaaccaaagcccattggccctttgacaatatgaacagttatgagttctggctgagtggctatggaggaagccaaagaaacagtgtcattaggataaccatgagaactatttgaagccacgtccgctgggctgcttggcctggcatccttcatgccattgactttgcctgttttactactgtggctagctggtgaatcataggtctcttgcccattcacaataattggttctttatccaaaatggctaccgaggtcactaaacttgtattggggtcatctggatcaaaaggcaatggataacctcggcagagttcaaggtccacgctggcaccaatggggatggactggaagatcttcacaacttgagcatgtgtgtgtcccaaaacacaggtgtcattcacacttacaatcacatcccctgtagaaggcaagagtgtgggggttaagaaaacagcacccagaaaattgtcatcagtattataatatctcccactaacataaagctgaactgaaactgcatgtgggtgtgatactatagggtataaagtgcttctattactgattttaacagctaataaagtgttctttcagcacctagtgtcttccctgctaatgagaatgtaataatcactcacagaacattggagctttctcctaaaaaaaaatctcactgcagaaatccaagtttagaattcatttatttaaatggggatctacagttttagtaactcattgctttactgtactcaaacagtttcccaaacttaaaatgacttcacaggttttaatctgtcccaagggatgaatttatgtaatgtggagacctggctcattctcaaggtgtttaaagctgtaaacatgtgcaatcatgacgttgcttggtcttgctcaaacaaacaacatcatgattgcacatgtttatctcctggattggagtctcaccacacagaacacactaaggccatgttgacgctacctgtttccatcttgccatccaatgcagcaggaccatctaggaccaagctcttgatctggagaaactcatcaggttcatcccctccaaccaccgtgaagccaaagccacgactgcttttccgcagctttgtgtgaatgaacttgcctttcaactcagaagggtttcgtgtaaaaaagggtttgcctggattaaaataagaaacgcataaggaatgtcaccactggtgaaaaggagaattaaacaagatttgagacaacatatagataattcttcacgcttatgccctagagcctttgggcatatagcatcttaagaaagtcctctcttaatttgaggaataaggatgttcctaggccccagtgttgatggagggaggtaaagcattgagtatgtcaactccagggtccaaaagaaactacaagagagggatgaaactagtccctgtcaggtgacacacttcttggtttccattcatgcactttgacaggaattgagctgccacaaaccccttcacagaaaatggaactggtctgttttatgtcttttgttttgttttaattttattttgctatatggcttctgatgtgctgctttgggcctggcttccacttgaaaaaccaacagaactaatcaaacggaaaatccaggctgaaaatgcacagataataccagaaaacatattatagtcacaaataataatttgacaaaaatgtagaatgactattttcaaaattaagggtcattactttgaattgaattctaaattcaactgattttttcctatttatctgatcttttattaaatttgtgatatagccaacgcatgcctagggctaagaattactgtttaaaacaagtttaggatatttgtttaaaaaacacaaaccaaaaaaacaaacaaagaaaccccccccacaacacacacacacaaaatccctaaactaagtagttactaacagtagccacacagctccaaattcagctgtcttatttaaaataaattaggctgggggtgtggtggctcatgcctgtaatcctagcactttgggaggctgagtcaggtggagcactgaggtcaggagttcaaaaccaacctggccaacatagtgaaatcctgtctctactaaaaaaaaaaaatacaaaaattagccagatgaggtggtggatgcctgtaatcccagctacttgggaggctgaggcaggacaatcacttgaatccaggaggtagaggttgcagtgagctgagattgcgccattgcactccagcctgggcaacaagagcaaaactctgtctcaaaaaaataataaaaataaaataaatttacagatagaggtatcgctaaattatttccaaacatgctacctaaggttttattgagttttcttgatacattcacaaataacattttgaacataaaccaaaacgttttcttttgggttttactaggcacttctctgtaattgagaaacttactggaacttctctgattatcccaagtagtagacctaatttcatgagcagcttctttcatctcttctaactttacttacttcttataccctgtccttgccacacacagcttctccatctgccctgtttcttttctatcaaaaatgttatccaaaacaaaaagagagagagaaagagggagacattagtcccctacacccctgtactaggagcctggcacctaggaaagaaagttatttttggttagttatatctaaaagagtttaaaaggtctctgggcatgcatacaatttttaattgcatattttaaaagtttctggctcttgcaaagaaggctcttttaaattgcctgcaatcagaggtcctttcgctaacctgctctctagcgcagtcccaaagcttattggaaggttgacaaactacagccctgtcatagtggctaaagaaaggcaagacttacaaggattcgccacgcaaagtcatctgccaaggcgttgggagggtggtgtcacttgcaccaagagctttggggagacagctgccaagacaattatcagatggaaattgaggtgaggtaagataacccccaaagtttactttagggggaggagggtgactggcctacactcttgtagcaggtgctgctagggcattccagggccctgaagggaaacacatttcagttatgcagagacatcaacagccattaccttcgcagcaagaccttccctaaccaccttactaaaaattgcagtacctccaacattcccaatccctttttcctgctttatttttgtccttagcatttaccaccttccaaaagaatatacatcttacttattgctttggttttcttactatccccaactcccatgcatgagtggcattgatatgcaggtacataaaaccactagaatgttagctccatgaggatttttatacgtatatcaagtatctagaatattgtctggtacattttatgtgctccaaaaatttctgttgagtgagagaatgaatgaacaaataaaagcacacagaaatgatatttatcatgtctttgagaaggctgaaaagaggtgtttggttgttggagcttttcactcttattataggctaagttagaaaacgtgaaaatgtgcctggcagtttatctacttaaaaaaaaatacattagcatattttgtgctgagaatgttaacttaataaagacatgagcagagctttgaaattatacgactgacttccttttccaatgtttaacaagggaaggaaaatcagagggtttcacatttatgcacattttattattttttacgtatgggtggatcattagttaatgtagcttttggaaagaaacgcttttcaccccataagcagtggaatttggagctctcagctgcagccctgtggtacatgtaattttctaagatcctaacctctgtttaccagtcaccagcggtaagacttggttgtgtcttacccagggaaaatcccctgggtagctttttaaaatgtactcattttcacttccttccttagactcactgatcaggatgttctgggtcttggcccaaaactctgcacctgaatgaaccttaggtgcatgtttccctgccaggatggggggaggggaaagaaatgtcacttcttgacactagtgtttaaataccctagaccagtaccgtctaatggcactttccgtgatgatggaaatgctctgcacctgcactgttcaatatggcagccactagtcacatgtagccactgagcccttgaaatatggctagtgagacagaaaaacttaattttttgattttttaactgtaattcatttaaatttaaatggcaacatgtaaccattggcttccataccgaacagcatagatttagactacacaaatgaggtatcccacaaaaactaaaacaaccaaaaacctttcaaacagaagttaaactattcctcatgtatagtgttcaaatctgtgctctgctacttagtggctatatggccttgggcaagttactaaacctctctgcctgagtatcacaagtataaatggaggtaatgatgatacctatttcacatgatagttgtgagaaacaaccatggcagataatgtaggtaaagtgcctgggaaggtacctggcacataataagagctcaataagtgagttattgttttgatggcggtggtgatagagtgagtgtggtggaggggtagctgcaaaaatctctctccaagcataagcttgaagctggagagttttcataagagcaaatctccaaattatcacttgctaagattagaagtacactcttgatcaggggagaatttagttggcctgtgaacttggcaaaattactaccaaacaatctaaccaaattagctatatggcttcttcctgacagtctatcaacactagatactgcccaagatacaagacactagacactagatggctaatcaagacacttaaccggtaggcaggtaacccagagttataaccaatgaggctaaagtctaggttaatgtttattgaaatcacagcttggagccaaatggtatggattttaactggtttctttggtatcagttatattccaaagattataaaagtgcttgaaacgtgtggatcaacagagagactacacagtagaagggtggtaagaataaacgagtcaatctcaaggagagttcagtgagcctgaaccttcagacactattgaatggtatttggaagtggggcctttgggaggtgattataccatgagagtggagcccacatgatgggctaattcttacaagaggaagagaactagtactttctctctctactctgcaccacatgaggatacagtgagaaaatggccgtctataaaccacgaagtggaccctcattggacactcgatctgccagcactttgatctttgacttcccagtctccagaactgatagataaatgtttggtgtttaagccacctagtctatggcaacttgttatagcagcctgaatgaagaaccagtggatgtcttagtcaatcattagatgactaaagaaagaaggaagagatataaggaaataaggaagaagagaaaaaaagaaaaagaaaaaaaggctgagttaaagaaaagtaagaatctgagatgaagtgtctaatacagacaaataccgtctcaagtcttagttggtgcactaagcatttggcactcagaacctgaacctttacagctttaatttatttaatttctaagataattatgtaagaaagtctggttggctattctatatgtatatgtggatggatggatggatggatggatggatggatggaagatggatggatactgtttcactcaataataatgtcatcagaaaatgtatatcaagggattatgcctagtttgggattatctcacagtgaaaaaacaaaaaacagagaatcatagtctcttgcctccatgggatttaaagtctaatgaggaaactattgttaaataatagcacacaaatgaacactagttataatggttaaatttcataaatgtgaagtacaggatggttaagagtaaacatggtaggggaatctagcaaagacctgaggtgaacaggagttagcagagtaagaagtaggaggaaaagacaactgcaaacagaaggaacagccactgcaaacagaaggaacagcctctgcaaaggctcagaagcggttcacagttttgctggttaaaagaactgaaaggaggctaacttactgtgagagaggggaaggtaagaaggcatgagcctacagaaggaattttatgtttacaaaaaaccccacaaaactgaggactccacagtcatgttgatactaatcaacattattatctactatatcccatctttattaaagccattatcaccattaaaaagtgcattcatgccagaagaaattattttacataaattgatactaattctaatctagtgacaatgtcagctagcagagaaacaatttctttcttatgaaaattataatgaattaaaattaaagaaatgaattattattctacttatctttttatatgtaacacaattaaatcttttaaaatatagaaaggaagacaaattttatagtatttttattgtttctgtaccacaaacatcccccaactctgtcaaacatgatgcttgtttaaaagaaaaagaaaactaaacacaaatattttctataatttaagagtaatgaggcctgaaagttgcaaggttctggagcttccaattttcaagaataatcctctataaaggcctcatcctatgtgtgaatgtaaacaaacaagacctattgaaacgttgtaaacatgcataaataccaaaactgcagcaagaatagggaatgagaactgaaaacacaatatcaaaccattttcatttataggaaagtcttagacaaaacctaatatgttggctagactcttgaaatatctaatgctgagtttcagatttatcttttttaacatactattaaatatctgtggtctctaagtcagtgattcctatctctgggatgggtttgctccccagagacatctggcaatgtctggggacaatttccttgtcacaatgagaggtgggctgtgtgctactggcatctagtggccaggggacatctcacaatgcccaggacaaacccacacaacaaagaattacttaccccaaaatggcaatggtgctgagattgagaaacgttggtttgaatgatcatttaacaagtagtctttatttttaaaatattacaaatagttggaaaaaaattattcaggaagattcctaatttttcttgacaagtctaacaatacatttatcattgttttcattatttatggttttcactatcaaaggaatgacttgggagttacgagattccacttttcaaaataccttaaaaaaaattagattttgagctaaaaccatgacacaattagaaagacaagtactttaccctgaagtggaacttctctggctggctctggattgcttggagggtggtttggaataacaggaggcacaagggctgagtgatcttctgtccattctatgaaaaagaaaagaaagtttcctatttttccttcaaatggctcattgagttacttatgattcaccttattattaataatactcaaggcaataaaccaagggcagatagcttagattaaaaagaagttgttatctgacctcattctatgaagctctttttttttttttttcttgtctaagacgttttgggaaagaaatattacgatataatgaataagaactccagttctctctggctggaaagtccaaagtgaagtcagttaaaaaatgtcaggaaagacatacagtcaactaatggcagctgtataagggagaaatttctctaatctgattcagacatgagctgggctgctgaggccagcttgtcttaggtagggaggaagatgaaggtagatttcagcagtttgctaagggtgtgctcttctgttatctctgaatccaaatgagacctattacaaatactcctgggtcctaattgtagtcttattcaccttggaaggccagacataactcacagtgagtgacccttgagatggcaccccagaatcacttccagctcagctaacatattcaattgtacattctcatttgcaaactgcactttctaacactaccaagtttcatcagctcaggaaagatacattaaaaaatttttagacaaaaaataacagatgttgataaggatgtagagaaaagggaatgcttatacactgtcgatgagaatgtaaattactgcaacctctatagaaccaccatacaatccagcagtcccactactgggtatctgaagaaaaagaaattattctatcagaatgatacctacacttgtatgtttactgcagcactactcacaacagcaaagatacagaatcaacctaagtgtccatcagtggataactggataaagaaaatgtggtatgtatgccatggaatactgttcagccataaaaaagagaataaaattatgtcttttgcggcaacatgaatggaactagagaccattaccttaagtgaaacaactcagaaacagaaagtgaaacaccacatgttctcacttctgagtgggagctaaataatgtgtacttacggacatgaagtgtggaataacagaccatggcaactcggaagggttggagggggatgaaggatgataaattacttaatgggtacaatgtatactatttgggtaatggttacactaaaagtccacacttcaccaccacttaatatacccatgtgtcaaaagctgcacttgtacccactaaatgtatatgagaagagttctttttagctagaaaagagactaaggtagataacatttcaatgggtgaatgtacacagacatacatacctactctctctaaattgtacagtccagggcagtggttggcaaactatggcccactagccaaactggggccaattcctgtttggatacagcctgtgagccaagaataacttttattctcaaatggttgaaaagtaataaaaaggagaatactttgtgacatatgaaaattacatgaagttgaaattacagtgcccataaagttttatttgaacacagctacacctattcatttacataatgtctacagctatttgcatactacaatggctgaggtgagtagttctaacagagattgactgtttaaatcacgaagcctaaaatctttattatctggctgtttagagaaaaagtttgccaacctgtagtctatggtttacatttgttatattcaatattatagtaacagaagcattatacttgatattctatttgatattcacatattatattgatgggagtattaagcctatgattctaaaagatcacaatgaaaaactggggaaagccagagtatctagtaataaacaaatggctaaataaagcagaggcattcatgaaatggaatattacgtcaccattaaaaagtataagctaaatctatattagccaacttagtaatatgtgcaagaaataaaaagtgagaaaacaggtctcacatacatactatatacgtataaattattatcagatttttgttaaaatatgcgtatatctatatccctagaaaatttctgcacagggcttatctctgagaatgggaagggggcaaccaggggagaatttaatgttctatactcccgaattgcccatatttttacaaagagcatgaattagtctgtaatttttaaaagcacccaaaactaccagctctttctgattctttacatgtaatgttcctaaaattaaaagttagtttcatgcccagtaactccacttaaagtaaaaatgctaaaagtggtttggatttagctaccagttgcaatgcaaatactgcgggggcaagaaatttcctcccccatcagaaagttctctgatctaatgatgctcctttctaaattaaaatggagatttgagtgactttgaattaggatctccactttggccatccagaggaacatggagagggggttctcttcctccccacaggacatcagctcttcagtgtggcaagagaggactcaatcatcgaggccagttctgaccacacgagggtgtcagcgctcagatttcaccccatgctcccctgatcaagaaaaagcctagaggaaagaggccaaccttctgtctgctgctgctgctgctgctgctgctgctgttgctgctgctgttgctgctgctgctgctgctcaagctgcttcttccgtttggcttctagaaccgggttctcatattgtgtcttcctgttgatgtggctggggaagatagcaaatagtattcagcttgaaacagttcatcccaccagcaaaatgccaatcagaccaagtccctggaatcaaactgagcagagcaggtggtctgagatgctaaccctcgtgtgttaaaatgctcagttagaaagaggaaataaaaatgaagtttccattactgactgcttatatgcactaagcactgggctaccagttttatatgcattttatttaaaagtcctcagtaaatgccaggaggtaagtcctatttttattcatatcttatgaataaggaaagtaagtgtctgggcagttaaatacttcatctagcataatatagctagtaagcaggaaacaggcatgcaagctcagggttgcctgctttcaaatcccaggattttaaccactgaccccactccaaatgtccaagataccacctgacaggggaagctgctttaattcaataagaagtagattaaggaattattgagacataagattaaagtggctatgtgacattgtctgtaacatacaatgccagaactgctgtgtaactgtctgcagtagggttcacagaagcataagcattcatccaaacaatgaagttaaacaaagaactccactcacatctgttaactattttgatcactaaacatagaggcacaattaaaagtacaggccttaggcagagagaatccaaataaagttaacctaagtagatgtgatgtgctcaaaatgacaaagatccaaacacttagatggctacaaaactaattatatatatacacatatatatgtatacatatgtatatgtgtacatgtatacatatacatatatacatatgtatacatatatatgtatacacatatatgtacatatatatggtacatatgtgtgtatatatatatacacacacacacatatacacacacacaagcatatacgtataaatatacattatttattgttttttgagacagtctctctctgtcacccaggctggagtgcagtggtgcgatcttggctcactgcaacttctgcctcctaggttcaaccaattctcctgcctcagcctcctgagtagctgggatttcaagcgtgcatcaccatacccggctaatttttgtattttcagtagaaatggcgtttcaccatgtaggccaggctggtctcgaactcctgacctcaagtgatccacctgctttggtctccccaaatgctgtgattacaggcatgagccaccatgcctgaacttatttttcttaattcaaaataatagtttattagaaatttaggagcatagtattgtgattatttagaactctaagttttttaaaaagctaggctttatttttttaagcaggtttatcaatagaaaggatagactgattgctcttaatttctattaaaggcctacatgtttatttcctaattcttgtagcaatttcattctaagaaatggtctaccattaacaggcacatgaatctgaaaagacagatggagaagtgtgtggtaagataataacttgcccctcaaactagtgtcttcacccataaaagcttttgtcatctgttcctgctctctcttaatgcataaactagttgagggacaattcaaaatgagcttcaaatagcaaaaaccccacagtacatctgtgagaaagatgatctttggggcacacaaaagaaatttattttctgagggtcagaggggcagccaagtttgcctctctgatgccccatattaccaatccctcttgttaggcaaagtggaggtaaaagttagtactggccaaggacacttgctatattgaactcataatttctacagtaagatgctgggcatctattttatggcctggcacttttttcatcttgtgttcatatcaccagggtattatacaaatgacttttcatcaccagcagcataaaggaaagaaaatatgacagttacatcttcagtgtggcaggtacgattatgtttctacaacatttatatggcatttgcttcttttgaagggacttttattagttacctctcatttttctctgaggaaactacataatacaaagctttttttttttttcaatgtcctaacctttgggtttcttttaatatcatcctatccatcaacagttttgatgaaaggaaaaagtgggagcccaatgctagaataaggcacacagtaaagtcacgagggttttagacttttaaaaatgggaaaccagaacctcaggcaagagagaaacaaagaaacacacaaagtctgcatcctaggctagttctccattttctcctcaatcctggcaacatttcataaattaccgtggctgaaccttttgaaatgtatgaatgaataaagaagtaattgctaaggagttcagatctgggtagagcaaaaagtagacgaatcagatactccttgtaaagataaacaatccctcttcatctggtctactgaatcctggcttttctcattcattcattcattcaactaatactcattaagtacctgccatataccaggacgatgttgggcctttgtgatgcagtggtgaacaaaagacatggatcctgcccatgtgaatttaataatatgatttgctattttcagatttattgaatattttctcattcattaatatatgcatacatattttcatcataaaattaatattgttaattggtttgtgccttataatgatgtcaggctgtacttaacacaaatgtacataattatagagaggtataaactaatgtgtggattgtgaatgggcacttactctacatagtagataccatagacagggtcttcaatcttttcccaaccagcaggcagttctgaaaaataaaagaacatttagggcaagaagagcatattcttgaagagcctgggtgttttcaacaactgagttaggcaaaaagagaaagactcataaaaatgctttaaatccaattaaaactgtatatcctaaccaaaaaaaaaaaagtatctattattttataagtgtatttttctacatgaacagcatttctttatctactggtattttatgcaagaaaataaaacttaacaaaatgcagcctttattctaaatcactattaaattagattttagtgaaaatataggttaaacttgccttgaatgcctagttcctatcttaaatgtttacggttttctcattttgttcctaggccatcttattacacaagcaaaaatggatgaaaattaatgtttcattttcagtacaatagtgttgttttgctctccttgaaataaaataaaatctgcatgttatcttctccttgttcctaatgaaaatgcagttgggtttttgaactgcacacaactatcactcaattgctatctctgggctggcccatctttctcagcacttaacctgtgaaagcagtaacacagctcctgatccctaagagctcactatctaaggcggatgattttatttctttaaatgtggtggtacaatggcactgggggatgtatgtgcctttctgaaaactcaaccatgctctacagaacttcctaaggtttcatatcaaaggccaaaactttattaaacaggtaatagttctgtctgaacaagaatctgttgtggaaaggcccactgcaccatattattttacttggtgaaagaagggactaggttgtgggttttttttgtcattaaacaatcctttcaggcagaacaacagttattcaacttaattttaaagcttccctgatacacgtagtcaaggcaaacttatgtaacaccacactctaaagtgaataattagtcctagaagtagctattaagaccaactttgatagaatactacaaacttgaaatatttgaaatagatttttgtttaattcaaggaatcatgtggtcactaatttaaataatgatgtcatcagggcagaaggcttacatataccacaaacagttccagactgaggtagaggcatgcacatgcacacaaacacatacaggctaattactcaaagtttatgttttgttcagatttggctgcacatcaagagacattaatttcatagtttttgctccacatgttacttgtttgcaaacaaagagacaggttttccccccttttcttctaaatcaaaaagaaaaaacatttagcaagttttaaagaagtctttgacttgtaggagacataagctactaaaatgcaagacaggtccaatttgcagatgttgatacaacttggcatttgtatatactgagtcttgcggaccgatgcaaattgaatgcctaggaaatgctttccccttacaaagctggaaattaccatttaaatgaaaatgaaccaggaaaatattaccaaagagttgggaaatcgaagattaaaaaaatgcaaattggtgcacagtcatacatttgtatagggcagaagggtgggtggatgtgaggagaccgcattaagtttcatagaaacgccatctcttttcaaaatctgcaaactgagatatgtggcctgattatctttagataaaacaggggaaatactaagcttttaagttactcagttattaatttgacaaacatttgttgaatgcctactttttgcccgagggtgtgttaggcaccagggacacaaagacaaacgcaagtgcatcatctaagcagaaaattcagccacgtggtatgtgctttgatggagggccgaggagggtactagaaaagaaggtacccgtgacttcttttctagtgcctagtcaacaacttaatattctagagttgaaaaatgggtccagtcaactggcatatctggacatttgtcagtttaaacacatcttttggaacagatgagcaaactccagaaattgaaaagatagtttctcacttccaatgtggtcattaacttaatcatagaaattagtctcctaatgcttaaaatagaaatgggtcatcgattttaaataggaagatggttgtcctagaatttgccatttggttctaaaagactgaaaaaggcagaaaatatttaagtccagaatgacattataattttttaagcaaacactctaaagactcttaaaaaggaatcctcgtatgactaaccacagtcagggagcagattagacagtacaacctatcacagagatttgaagtggctaagatccttttggcattgcccagatataagattgagccttaattctttcatttatctctactactctgtggccttgggctacttacttaacatctctgaaccacatctttctcctggatttacctcaaaagtcaatggtggattaaacaaagatacttctgaacacttagcacagttcctggcacatagaaagtgtccaacaaatggcagctgttccaggaaagcacaaaaggaataggacagatgtctgtggcctgtgtacttgctactcctgcctctgaaaatctcatgctgcactattttgtctccaaagagcaaacattgagcagtcaaaggttctaagttcttttcaaagagatttctctgtatatagattgaaaatcatgttcaaaatcagagatacatttcaaaactgtgacttagttttgggtgggaggagaacttactttcttggctctatctcccctagttggtttcaccacatggataccctataattccaaaagaaggttctgcaggtgctttttaattctggggagatgtctgcagaggacgtgataaattctgcaaaccaaagtacataatggagcaactgacccagctcaaacaacagagttcagaaatgacaactctataatcaaatgatctgtgtccaatacccaagccaactgcccacgcctctcagaggccgattacaaagagggtttccttgtcacatctggaattacattgttcactgaaaacctgacagttgctattgtttgaaattaggaccctcttattaagaaaatgagcagtgagcttgtcaacagaatctggagtgaatgcaacagaaaacagtgtgtgtgcacgtgtgctactctttacacagtggacatgtgcaggcaaaaatcaaaggttttatctctacccttcctacaagaacacatttgggccatttctataatatagaacacattcctcccttgtgctgtgttaatggaaaaaagtaccataagaaagtactgaaaaatccaagaagagggaattaggtaataaataacaacactgcaaatagctaatagaatgtgctgatcacagggacaaatattaaaacacgctttcattaagtcacctcataagcaccatgggagctactcttttggcccctctttatggataaggaaagggaagctaaaagaaggtgaatagcttgtctaagtttgcatagccagtaagcaggggagccacacagtttgatctgaacccagagaaagccaagagaactcatgtttagagtctttaacagcacaagcaagtcaccacgatatcacagttacatgtgggtaaaatgcagaaacttctttcctgaaaatttcaaattcaaatttccagagaagcaaataaggttgtgctcctgtacacagctgtgctatctccactggctgccagcagacagcagagtgatctgtcacacctattacttaggtagcaagagtggttgaaattggctgaacaaatgattaagacactcattttgtgtctggaaaacctatttctgtctctttcatttactttatctaatatcattggattgacaaattctttttttgatcaaattagtttcaaattgttctatcattcagggtgaaccttaagtcatccctctcacaatgaccacaaagacaacttattaaacatctttaaaaatagatccatcaatagttattgaccattgttggcatgtgcatcaattacaacagacaggttccaaatgttaagaaaaacagagcttggttctattctatcataattctagccaaccatgactgattatctttatctcacgtaacaaaaataaagaaaaccaaatgaatgcaataatctatactaaatagacttatattttcaggtctttaggcaatctcaaaaatgccaggcagattcaataatcttagtacagttccactcatactgatgttaaacaatcttctacttaaacaatcttcaattgctaaagaatcttccatcagccgaggctttcatcagcaatttagctgaaacttatgctttcctatgtatccatcagcaaatgtatcagacggaatgcaaactaattttaatgttgttcaaggttgaacataaaggactgaacgtaatagcaaacgtaattcaatatattccaatagcaaagaaacaagaatttggcatcatctgctagtataaattattcctaaacaacaataactagagtagtcaagacttgatttgcattgacacaactctaaggcaaacagtacatacagatgctgcatcactatataaacaaccactcactacaatggcaaggtcaacaacacgtggtctgggacgtaataacaacacaatcctaagacttaactattcaattcctcagtgaccttcttttattgcaagtgctcctataatgttccttaaactagtcttaattgatttttgtttgtcctgcttggcttttttgtattacccaaataaccatccgtactaaacaaataaagaaataagactgagacaggttatgccaaagttcaagggacacagcgagcatctcttcggttctttcccaatcctcactttacaagactacccattaccaatttgctaactctcgttctagtctctgttcagtcagacattttctttgtaaacataatgtactacaactccgcgtgatgcctgcaggcagacacgcaggttgtaagactgacctttcctggataagctagaatgaaaatcataattggaggagtgcaaactaaagaaacagggattaagcaattcactggggaagaaaaccatgcaggccatgtcatgcacgtgtcatgcagcagcagcaggcagggagggtttacctagttcactgtccagctcctcggtgtgtaccccttcttctccaaaggaatagcaggaatgagacagaaaagagagaaagcaaaattcagacaccagcaccaagaaaggaaatctcctcaggaaaacagcagcaaacacatcactctagttcatccttacctgcattgtggcttatttcattggcttggatagtaaacttgcgacctcagtgtaaatcacaaaacgggaagagctgatattggcaaaataattacatggctcatttccttgcatgtcaaaataggatttgattggttgtaaaagatgacaaatacctttgcggtttcaatgttcttaagtgggaagtcacttattacagaccttattgggagtaaacaaagctgttagacctttcattatcagtccttttaatccttcaataatcctctaatcagtgaggcaattatactcacaattaaagcattatttaacttacaagtaacagtgctgcttgaaaaatggaaggtgaggtcaaattgaaagtgcagactgtataatgagctaactttgatgtctttcaaaaaggagctggaaagatgaattacgtcaagataaaatatatcaaagaagaaagccttgaaaactgccctgaaggagtgttgggaggcatttaactggttttgtgagaaaacacatacacacacacacacacacacacacacacacactttctaagtcaaggagctcagaaatattagaattaaaatgtcctcaaaaatttcagggagcaaaacaagtccaaatcctttctgttcttgacctcgtcctcttgctgtcagtacaacattttcttattgttgagaagaaaacatgggagaacacacaaaaatcatttcatacataatgtttccccagggtcagggcaagtggctcctataagcttcacaaacacaggaattgagcctgttttcagtaccacaatacgctcagtgcccagtgtagccttctgcacatgttaggtactaaatatttcttgatgaatgaatgaatgaaccaatcaatcaatgattgacttaaataaccaacatgggcctagacaccttgtaaactcttgatttgttgtggggtggggggagggaggagggatagcattaggagaaatacctaatgtaaatgacgagttaatggatgcagcacaccaacatggcacatgtatacatatgtaacaaacctgcacgttgtgcatatataccctagaacttaaagtataataataataaaaaaatgatcccactgccagcggtaagttttgattggcaccgtttcttaaaaggagaatctaatttacacaaagtcatctgtgaaaatgcccatttggatattatctaatgtctttgggagcatttgttcacttcttcagtagttatttatcaagacctatgatgtgccagtcactgtgctaggtgacatatcaaaatgaacacaatcaggggccaggcgtggtgtctcatgcctgtaatcctagcactttgggaggccaaagtgggtggatcacctgaggttgggagttcgagaccagcctggccaacatggtgaaaccccgactctattaaaaatacaaaaaaattagtcaggcaggtggcgctcacctgtaatcccagccactcgggaggctgaggcaggagaatcgcttgaacagggaggcaaaggttgcagtgagcagagatcatgccaccacactccagcctgggtaacagggcgagactccatctcaaaaaacagaatcagacatctctacttttccagaacaggagacaaatccaaggctcacacaaataaaactaaaattaaaaccatgataagttctcaacagagtaagatacatgagtgacctaatcatatttttgggggcaaagtcatggaaaaattccctgaagtataacctgaaggatatgcaaagtttaatgtctgttgtattcattgacacattcgaatacctaggatgcacgtgacatacagaaattattcaataactattgtgaaatataagagtatagtgaaatgtaagcgtattctaagagagaaatgcacatttaactgacatgaggcaggaactcaatgaggactagtggggatgaagagcagagagcagagaaatagtgtgagaaaacctagagaggctgaccacacagggctcagagtagcaagctatggacctggcatttcctaagcagaccctgtggaggttgtcagcgataacatcatcacatttacattttaaaagatttctccgagtacaacataaaaaggagagtgaaaagagtctgtatgggagatgagcatgatcccagatgagaatggaagatgcggtgaaaaaaatagtgaatggatccaagagatatttaggatgccaactgaattcagctggttcacgggttagaaataggtgtgaagaaaagtgacatatcaagggggaattttgagtatgcataaatttaccatgaatggagacaggaaacactttgtatattacgtaatttggggggaaagatcatcagttttaatggttttaatacgactaagtcgaagtatctttgagacaatcgttgacattatcaatcacatggattacaatattggtctggagttcaaaggcaacactgagggcttctaactgaactggacacagcagtgacagaaggagtcattcactaacatcaaaatctcaaaccagtttctcgattttctgagataggaaatagaacatattaaatctttataataattaagtatgatgctatactgttacacctcatatgtatgacctacagagaacagaaagaaatacagggacaatatttgcaaccaatatgtttttctgctttgtgttataaataataacaaggcagctttgcgttaactggcaacagaaaatgcaaactgatacttaccataatctgattatatatttatactgtttgtgtgtacaggcacacagatatacatagaatttctactagaaacagaatatatgaattctaatattaaagagataattataaactaactgcatttggtatgaatacattcttgttccaaaggaaataacattaacacaaaaagataagaattttaagaattaaaaattactagatttggtaacaaaaatgccaattccattcaatactttcactctatgtacagtttttctcagtaaaagctattgcagtattctatcacttataatattgtattaacaagcattttcatacattcccagaataattacaaaagggatattgacattgaagaccctatggtaataagtgcctaaattgctttcaaaatcataaggcatcaaataatgattattgttccatgaaattttagggttgaatgtgttttatgctatgatctttgaaaactggttatttatgttcaggttgagtagtcattatccaaaatggttagaatcaaaagggtttcagattttgcatattttcagattggagatacttgtgtaatatacttactggctcagcattcctaatccgaaaatccaagatccaaaatgctccagtgaacatttcctctgagcatcatggtgacactcagaaagttttggattttggagcctgttgttgctttgtttgtttcttttaagacagggtctctctctgtcaccaaggctggaatgtagtggcacaatcacagctctctgcagcctcctactcttgggctcaggtgatccttctgcctcagcctcccaagtagctgggaccacaggcgcatgccaacacgcctagctaatttttgttttattatttgtagagtcaaggtctcactacattgcccaggctggtcttgaactccttggctcaagtgatcctcctgcctcagcctcccaaagtgctgagattacaggtatgagccacaccatgcctggccagttttggagcattttggacttcaaattttgggatcagggatacttaaccagtattacatgttaaacagaatactgaaataatcagtatagtctattatctcccaagcatgcaaaataccagagctgaatgaacctgttctattccttcttcaggaatcaaacaaagcaaccaagataaaacaaagcaaccaagataaaacaaacatcttggtcatgcctcctaagttagaaggacttttgtttccatttgaagtaactcagataaataccaacacaatagtctatgtcatttaacgtaatctgcaaaccatgtataatagaaggatcatggagtgcaaggttttcacagtattatactataaaatactgccttgcattttcaaaaaatcttcaagtttatatatacaaccattctgcactataggacgaataataaagttctgttatcttacagtaaaatacatatttaataattatactactaattcacatgccagaattgaataatgagtagcaaagcagagcgaagcaaaccatttcccttttcattcttccacatcaaaaaataattttggtagaacttgggatagacgttggtgtactgaaaagggacacactagctctgtttcaattttttttttttttcattttggagaagtaattagaaaacccaaagccttgaaatgaactttttcaacaaaagctcttacagccagttagttcatttccaagattaacagggagagtggtgctctaggtaacacctcaacctctgtctcaaaagaatacacttactacatattgtgggtatactctaagttacacagagattctcaaacatgtctagatctgtttcccctacctccaagactagggaagtatgtgaaatatgtacagttcaagaaaaactcccaacttttccccctaagacttttataagatagggttaaacctgagaatgtgtgactgaccagaccgtctttggtttctttattcctagagactttctagaatttactctaagttcctgaagacagaggacgtatcttcatttgaacagtttctgactgttctgcttctaatggagatattagtaagcatctgtctttatgtgtaaacaaattcttctcttgaaacaactctgactttcttcctgcttttgtaaaccacagtccatttagcagaaattggattaccttttaaaaactcaacataagacccgactgacctggctacgactctttaaaatttgcacatgtgaacagtgcccccaattcacttaacccaagacctgcctggccccttaccatcatcttcacactcttccagtggcttctgctgcttgtttaggcaccgagggtctaaccaagatgttgttttcgtgttatggctgcaatccagaaacaaaaataagaaatttgtttgaaaaaaaaaaaaaaaagcaagaagcccaatgacggaattacacactcttgaatatttcttccttaactacaacaaagatgctttccaacagcaaatccaaaccagaagagagcctgagtttacaattataaaatggcttggggagggtcttaggtaggctttttacttacctaacatatgattattcaattactgaaagcttaaaaaataataccagttttatttttgaaaaataagttacaaatgataccccttgcgtataccatctacccttgtctagattattttaggctttgcatttgccacagagaaaacttccatttattttaagtatatctatgacttgagtcttggatgctgaaactcacaaagagggctgctatttcattcattatattacataagaattctcatgacagcatgaaactaccttaattcacataaatgactcaaaactaccaatacacatcattaaatcacaatgtcctaaattatgctttggacataatgaaggcagccccaaattactcgtcataaatagaatctggaccaaggataagcttggagaggctaaacatgtcactcaactgccttttaagggataaagttcaattctagatgaagtatttcaacagatggtgactggggccctgcagatttgaaagtgtagagacacattcccaaagatatcgccattcaatcatattagaaatgtcaccagaatggttggaagcattcagcttttgtgcttcccaaagcagtggctgggacaaagttctgcttgagcccccagggcaccatgcagctaagtgggtggggcaaacaactccagtccagtagttctggctacaaactagacatgaaaacaaattggaaatcatcattctcagtaaactattgcaagaacaaaaaaccaaacaccgcatattctcactcataggtgggaactgaacaatgagaacacatggacacaggaaggggaacatcacactctggggactgttgtggggttgggggaggggagagggatagcattgggagatattcctaatgctagatgacaagttagtgggtgcagcgcaccagcatggcacatgtatacatatgtaactaacctgcacattgtgcacatgtaccctaaaactgaaagtataataataataataataataataataataaaaaaatacttgttttacaaaaaaaaaagaagtttttttaaaaattaagttcaggcagtaacttaaaactttttttgaactgtgacatttcggttgtaaatttgggagttggcagggaagagggtttgccaaagttttttatttttgattcaaatcttattaattgtcaaaaaaaaaaacatatggcttaagagaaaaacagaatctgcgaatgtatacacgtcatatcaactgtgttaaaataaaaataacaaaaggtaatatagcaaccaccaccatcaccaccacgtatgactgccagaatctgttcttacaataaccctatgagagaagtattattagcattaaaattattgctccccatattacaaatgagaaaactgataatagaaaggtaaagcaatttgtctaaggacaccctgctgagacatcacagaactgggaattaaacccagaaagttttgcactagaatccacagtctgcactactcctacacagtaagataataacaaggatcattgttaggagaggagattatgcaggattaagaaaaaaactgtgtttaaaacaaaaataactgtagattcacattcagttaaaagaaagaagagagatcccacacaccctttacctagaacccatcaataataacatcctgcaaaactatagtataccgtgacaactaggatactgatactgacacagtcaacatacaaaacattttcatcatcacaggggtccctcacgttgctcttttatagtcacaactggttaccttccaaccattccccccaaccctcttcttaatccctggtaactacgaatctgtcctctatttctataattttgtcatttcaagaaggttatatagcgctgggcggggtggtacatgcctgtaactccagcactttggaatgtcaagccaggtggattgcttgagctcaggagttcaaaaccagcctggacaatgtggtgaaatgccatctctacaaaaaaatacaaaaaaattagccaggtgtggtggcacacactagccaggtgtggtggtgcgcacctgtggtcctagctactggagaggctgaggtagcaggatcacctgagcccaggaggcagaggttgcagtgagcagagactgtgccactgtactctagcctgggcgacagagtgagatgctgtctcaaaataaaataaaaataaaaataattttaaaaagaatgttatgtaaatggaatcattgtatgtcttactttatgactggcttttcccctcagcataattctcatcaagattgttgtatatatcaataatcaattcttttcattgctgagtagtattccatggaatgaatgtatcacagcctgtctaaccactcaaagacatctggatcatttctagtttttggctatttggacaaatttgttataaacattcatgtacatgtttttgtgtgaatttaagtgttcacttctctgggataaatgatcacgtgtgtcgttgccaaatggtatgagctgcatgcttagtttcttaggaactgttttctagaatgccagacaatcccaccagcaatggatgagagatccagtttcactgaatttttaccatcacttagtgttgtcactattttttactttagccatcttaataagcaaatgacatctcattgtggttttcatttccatttccctagagctaactaattttttccctagggctgaactaatatttcatgtgcatatcttccatctatatacccttttcagtgaaatgtctgtccctctgtccctctctttagttcacattctcaatgaatggtttgatattttttttttttcactccggagttttgagagtcctttgtatattctacataccagtccttttttaggtgtggagtctgtaaacattttctctgtagtttgtcctttcatcctctatcagactcttccacaaatcaaaaaattttcattttaatgatgtcaaatttatcattttttctttctcagggatcttgcttttgatgtctctttgcctagccctgtatttcaaaaattttctggttttttggttccctaaaagttttattgttttatgttttacatttcagagtctgaattatttggggttaattttttggtatgaagtgtggggtttaggtggaggttagcttacatgcctctggtcgtccacttgctcttggaccatttactgaaaaggctatctgccctccattggaatgctttcaaattgaattgcttttgtaaaaaatcagttgggcacacttatggatctatctctggttctgccttctgtcccattaggttatgagtctattccttcaccaataacacacagtctttattattgtgactatataataaagtcacaatatgtaaattagtacatttgatatcaagcagactaattactatgacttcattcttcctttttgtaattgttttagctattctctttcctttgcctttccatttatattttagaataaacttgtctgtatctacaaaaagactgagattttgacagaaattacattaaacctgtatatccatttggggagcactgacatctctatcaattctgagtcttcctgtatgtccacgagacattgtctcaaaataaaataaaaataaaaataattttaaaaagaatgttatataaatggaatcattgtatgtaatactttatgattggcttttcccctcagcataattctcatcaagattgctgtatatatcaataatcaatttcttctattgctgagtagtattccatgaaattaatgtatcacacagcctgtctaaccactcaaagacatctggatcatttctagtttttggctatttggacaaatttactataaaaattcatgtacatgtttaagtatatctctccatttataaggaacttctttgacctctttcattagcattttatagtttacagtatataagatccaatatatggtttgttagattgacacctgtattatttttttgagcaaccttaaattatattttatttttgattttggtaaccaagtattctagtatatagatatacacttgctatttattaaattttaaatttttgtgggtacatggtaggtgcacatatttatgaggtgtagaagatacttcgatacagacatacaatgtgtaatgatcacatcagggtaaatgaagtgaccatctccctcaagcatttattctatgttacaaacaattcaattatattcatttaattatttttaaatgtacaattacattattattgactacagtcaccctgctgtgctatcaaatactaaatcttattcattctttctatttttttgtagccattaaccatctccacttccccttaccaccactccaccacccttcccagcctctggtaaccatcattctactctacctccatgggttcaattgctttaatttttagttccacaaataagtgagaacatgtgaagcttgcctttcagtgcctggcttatttcacttaacataatgacctccagttccacaaaggttgtcgcaaatgactagttctcattcttttttatggcagaacagtacttcattgggtatatggactccactttctttatccatttatctgttgatgaacattcaggttgtttccaaatcatgactatggcgaatagtcctgcaataaacatgggagtgcaggtatctcttcaatatactgatttcctttaggtatgggtacatacctagctggatcatgtgatagctctatttttagtttttctgtttgtttgttttttttttttggaggaacccccaaaccgtttcccatagtgattatactaatttacattcccaataacagtgtgagaaggtttccttttctccacatcctcgccagcatttgttattgcctgtcttttggataaaacccattttaactggggtaagataactcattgtagctttgatttgcatttctctgatgatcagtgatgttgagcaccttttcacatatctgtctgccatctggagtcttcttttgagaaatgtccactcagatctttcccccatttttcaatcagactactagatttttccatagagttgcttgagctccctatatatattctcgttattaatcccttgtcagatggacagtttgcaaatattttctcccattctgtgggttgtctcctcactttgtttccttttctgtgcagaagctttttaacttgatgtgatcccatttgtccattttgctttggttgcctgtgcttatggggtattactcaagaaatctttgcccactctcatgtcctggagagcttcctcaatgttttgtttcggtagtttcatagttggaggtcttagactaaagcctttaatccattttgatttgactttagtatatggagagagatatgggatagtttcattcatctgtatatggatatccagttttcccaacaccatttattgaagagaccatcctttccccaatgtgtgtgcttggcacctttgtctaaaatgagttcaccgtagatgtatggatttgtttctggttctctattctgttccattggtctatgtgtctgcttttatgccagtactgtgctgctttggttactacatctctgtactattatttgaagtcaggtaatgtacttcctccagttttattctttgactcaggatatatttggctattctgggtctttcgtggttccatataaattttagaattgttttttatatttctgtgaggaatatctttggtatattgatagggattgcattgaatgtgtagacttctttgagtagtatggacattttaacaatattgattcttccaatccatgaacacggaatacaactgctatttatatgcttatcttttatcttgcaaccttgctgaactcgcttattataaaattttctttgtacgtttctcatgattttctactaagataaccatataatctgcaaacaggagtagttttatttcttccttttcaatctgtatggcttttacttctttatcttgaactataaccctggctagaaattccagcatgatgttgaataaccacgggaacagctcagcactttgggtggctgaggcaggtagatttcttgagcccaggagttggagaccagcctgggcaacacagaaaaaccctgtctctataaaaactacaaaaaattagctgggtgtagtggcatgtacctgtagtcccagctacttgggaggctgaggtgggagaatcacctgagctcagagaagttaagactgcagtgagctgcgttaacaccactgcactccaacatgggcaacaggagtgagaccctgtctcaagaaaaaaaagaaaaaaagaaaaaagagtggggacaactgacatccttggcttgttttcacacttgcagggaaggcatttcatcttttcactattaagtataacgttggtcattggttttctgtagatgctctttaacaagtcaaagaaatttcccttaattcctattttcccatgtgaagactgctgaattttgtcaaatgctttttctgcatcgattcatatgagcattgattctttagcctgttaacatggtgggttacactgattgatttatttgaatactgagaaagccttgaagcactagaacaattcccacttgatcatgggaaattgctgattactacttactaaattttgttaaagatttttgcatttatgccttttttgtactgtgtttagttttgttatcaaggtaatattagcttcataaaaataactgtagagtgttcttcctcttttattttctggaagacattatgtagaaatagtgtaatagttcaatattcctttttcaggagttcttaaatatacaaattcatccctcattatcttttttttttgtgatgagtgactcctcatttaagcctgggaatactacttgcattacttatttcttcttcttttttaaaaaaattatacttaagttcagggatacatgtgcagaacatgcagatttgttacacaggtatacatgtgccatggtggtttgctgcacccatcaacctgtcatctacattaggtattactcctaatgctgtgcctccccttacccaccaccctccaacaggtcccctagtgtgtgatgttcccctccctgtgcccatatgtcctcattgttcaactcccacttataagtgagaacatggggtgtttggttttctgttcctatattagtttgctgagaatgagggtttccagcttcatccatgtccctgcaaaggacatgaactcattctttcttatggctgcatagtattacatggtatatatgtgccacattttctttatccagtctatcattgatgggcatttgggttggttccaagtctttgctattgtgaatagggctgcaataaacatacgtgtgcatgtatatttatagtagaatgatttataatcctttgggtatatacccagtaatggaattgctgggtcaaatggtatttctagttgtatatcctggaggaattgccacaccgtcttccacaatggttgaactaatttacactcccaccaacagtgtaaaagcatctctctggcatctgttgtttcttgactttttatttatttatttatttattttttgcgatggagtcttgctctgtcgcccaggctggtgtgcagtgacacgatctcggctcactgcaacctccacctcccaggttcaagcaattctcctgcctcagtctcctgagtagctggaactataggctcgtgccaatacacccgcctagttttttgtatttttagtagagatggtgtttcaccacgttaggcaggatggtctcgatctcctgacctcatgatccgcccatcttggcctcccaatgtttcttgactttttttttttttttttttaagacagagtctcactctgtcgcccaggctggagagtggtggcgtgatcttggctcactgcaagctccgcctcccgggttcacgccattctcctgcctcagcctcccgagtagctgggactacaggcgcccgccaccacgcctggctaattttctgtatttttagtacagatggggtttcaccgtattagccaggatggtctcgatctcctgacctcatgatccacctgcctcagcctcccaaagtactgggaatacaggcgtgagccaccacgtccagcctgtttcttgactttttaatgattgccattctaactggcatgagatggtatctcattgtggttttgatttgcattcctctaatgactagtgatgatgagctttttttcacatatttgttggccacataaatgtcttcttttgaaaagtgtctgttcatatcctttgcccactttttgatagggttgtttttttcttgtaaatttgtttaagttccttgtagatgctggatgttagccctttgaatggatagattccaaacatgttctcccattctgtaggttgcccattcactatgatgatagtttcttttgctgtgcagaagctctttagcttaactagatcccatttgtcaattttggcttttgttgccattgcttttggtgttttagtcatgaagtctttgcccatgcctatgtccggaaaggtattgcctagattttcttctagggtttttatggttttaggtcttatgtttaagtctttaatccatcttgagttaatttttgtataaggtgtaagtaagagatccagtttcagttttctgcatatggctagccagtttttccaacaccatttattaaatagggaatcctttccccattgcttgtttttgtcaggtttgtcaaagatcatatggttgtagatatgtggtgttatttctgaggcctctgttctgttccattggtctatatatctgttttgctactgatactatgctgtttcggttactgtagccttgtagtatagtttaaagtcagatagcatgatgcctccagctttgttctttttgcttaggattgtcttggctacatgctctttttctggttctatatgaaatttaaagtagttttttctaattctgtgaagaaagtcaatggtagcttgatggggatagcattgaatctataaattactttgggcagtatggccattttcacaatattaattcttcctatccatgagcatggaatgtttttccatttatttgtgtcctctcttatctccttgagcagtggtgcgtagttctccttgaagagctgcttcacatcccttgtaagttgtattcctgggtattttattctctttgtagccattgtgaatgggagttcactcatgatttggctctctgtttgtctactattggtgtataggaatgcttgtgattttttgcacattgattttgtagcctgaaactttcctgaaattgtttaccagcttaaggagtttttaggctgagatgatggggttttctaaatatataatcatgtcatctgcaaacagagataatttgacttcctctcttcctatctgaatatgctttatttctttctcttgcctgattgccctagccagaacttccaggtggtaagagagggtatccttgtcttgtgccagtttcaacgggaatgcttccagcttttgcccattcagtatgatattggctgtgggtttgtcataaatagctcttctcattttgagatatgttccaacaatacctagtttattgagtgtttttaccatgaaagggtgttgaatattattgaaggccttttctgaaactgttgagataatcatgtggtttttgtcattggttctgtttatgtgatggattatgtttattgatttgcatatgttgaaccagccttgcagcccagggatgaagctgacttgatcgtggtggataagctttttaaagtgctgctggattcggtttgccagtattttattaaggattttcacatcgatgttcatcagggatattggcctgaaatgtgtgtgtgtgtgtgtgtgtgtgtgtgtgtgtgtgtgtgtgtgtctgccaggttttggtatcaggatgatgctggcctcacaaaaagagttagggtggagaccctctttttctattgcttggaatagtttcagaaagaatggtaccagctcctctgtataactctggtagtatttggctgtgaatccatctggttctgggctttttttggttggtaggttattaattactgcctcaatttcagaacttgttattggtctattcagggatgcaacttcttcctggtttagtcttgggtgggtgtatgtgtccaggaatttatccatttcttctagattttctagtttatttgcatagaggtatttatactattctctgatggtagtttgtatttctgtaggatcagtggtgatatcccctttatcattttttattgtgtttattctattcttctctctttcagggatgccctggccagagaggaggaatctccacctcttattatcttgaatgactttagggtccatagtgactccttacttaattcctaatattgacaatttggtctgctctcatttttttctttgtcaatcttattagaggttcttcaatttttttaatccttttgaagaatcagctatttctttcattgatttttatctattgtttttcagctcttgacaatttctcctcttacctttattatttccttccatctttttgagcttaagttattcttctcttcccaggttcttgcactgggagtttagattgttaatttgagacttttcctcttttctcatatatatgtttagtgctgtaaatttacctctcatcactgccttggctgtgtcccacctattttaatgtgctgtatttacattttcattcagttcaatttatttgcttatctttaatttcccttgagacttcctctttgacccatagattatttaaaagtatgttgtttagtttgcttctaattcattggagattttcctactgtatctgacattaatatgtcaactcttgcttctttcgattaacatttacaagatatatttttccatcctttactttcaacatacctatattgctacatttgaaatcatgcgtcatagatagcacacaattaggtcatgctttttaattcactttgccattccccatcgttaaagtgctgtatttagttcactttattaaatgtagttattgatatgttagggcttaagtcttccattttgtttgtaattttctttttgttctgtttttctttcctctgttttatttttctggcctttctgtgggttacatgaatattttagaattctgtttttatatatctacagtactgttgagtatatctcctttgtatagcttttaagtggctgctttaggtactacattacatatatatgcacacattttatatatatatatatataatctataaatatattttatatatcttatagtctactggcattatcattttaccgctttgactgaagtagataaaccttatctccattgatattcttttaccctccctcacttataatgaattaccttaaatattctctctacacacatttagaaacattaaacagtactattattgcttcaacactcaaacctaatttggaaaatttaaagagatgccaattatatctcaataaaaatgggaaaaaagaaaactcaaaagatgaagaaaagtattttatttatctatagttttactttctccattcttctcttttcctcattgtttttgttggttgtttttttttttagaattttggtattgttttagaattctctttttgtttagagaacatccattggccatttattgagagtaggcctgctggcagcaaattttcttagttttctttcgtctaagaatattttcattttcccttgattcctaaaggttattttcactggatgtagaattttgggttaattcttcttttctttcagcactagaaaaatgctatgccacttcctttcggcctttgttgtttctgatgacaaatatgctgtcattttacttgtttcactaacatacatagggtgtcatttctcatcgctttcaacctttttctggttttagttttcaaaaatttgactatgaatgtgtcttgctgtagttttctttggattcagccagcttattgaatctgtaggtttatttcttttgccaaattcagaaaattttcaaccattagttcttcaagtacttttcttttcagtcctacccactttctattcccctgggactccaatgaaataaatgttagatcttttgttactgttccaaatgcccctgaagctctgtttgttggttggttggttttcttcccccagttgattttctctctattgttcttattgggtaatttctattttcaggtccactgattctctcctctccccactctcttctgctgttgaatccatctactaagctttttgttttggctactgtatttttcagttgaaaattttctactttttttaaatcatctatggctttgctgagactttctatttttggctgaaacattctaattttctacttggcttaagcatggtataactgcttgctgaagtaattttatgatggctgcgttaaaatctgttaggtaattctaacagtgctgttatcgctgtgttagtatctactcattgccttttttcactcattttgatatcttcctgattcttaggataataagtgattttttttattaacatggattttttggtattacattataggggtctggatcttaaaccttctatgggcttttcctaatatggccgaaaagaggaaagggggctatctgttacttttaggtggggtctccatttggcttttgttgacaccggagaggggaatgggctccttcttaccgctgggtggggatagtggcttgagctccccaccaggcctttgttgataccagctaggctgggaggggtaggactatctcactattgctcccaagctggcctctctgactccacagggagagggtgggctcttcaccattggatgggggtaaaaatcctgattctcctctaaacctcctctgacaccacaccagtggggaggaagagggtgtttcattactgccaggtggggtggaagtcctgagttccctcaagtggtctccactaaatctatgtggaaataaggggaatttccttactgcctggatgcaaagtgccagctctacacttggccttttctgacgccacccagcagggaggtttcagctcctagtcccacagcctgtcaagcttctacccttggggcgtaggaccacaggtttttctgcactgttgctggagtagaatggttgttggataaaagttttctgtcttgtaggatgcccctttcctgatcctttggctagagagagcacgcttttatcagggctttatttgcctctatctgtaggcatttctgggttgctggctctttagctttaagtctggataaatggagtaaaacagaaagggaactcaccacctagtattcctttgatcccatgctccctagccagtctgtcttatttgctcttcctttcaaagtcttcttatgtttgttttctatacaatgccaaaggtttataaatccatgcttgattttttaatgttcttttaaatttctactatttcttcaacttcccaaaaactataaaacaaatgtgtatatatttgcatgtgagtgtacatacacgtacatgcataaacaaggtagatctggttctaatgcggtttaatttgctattcaatggaagatatcctaaaaagaagtgtttcggaatgaaaaacacatgaaaacaaagtaacaagtatatataatttaggctaaaatataaatgatatgtatctaatcacttaatatatatgaaatttgatagttgcagcccaaatcccataattatcattagccacatttttgtataagttttctactaaaccttaggtaaatgaaacattggcttcacatcagctaaaacctaagttataaaaagtaggcaaatcactacattctcttgtaagccagccatagtttaggaggccagcatcctgctaaccatcaagatatccaccttccctttttccaatatatcaagtcagtcttgaacaaaattactggtacattcttttctaagaatctgagtttcacagattattctgtaccaggaacacctattatccttcccttttctcagcgtaattcttctttactaatgtgacataatttcgaaggcaatttaatgcaaaagctaagtaaaaaatcctgagtttatggttggtatccatttttataacaatgtttaaactcctcagaataaccacagataatgatgatgaaaatggtaacaataacaatagtgatcactaattactactagcccaagaactttagcttctctatctcctctaattcttacaacagtctgacaaggtaggtacaattcataatattcaagtcctctttttatatatatgtatagaaagctgagatgcaagaagtaaactcaagttcctaaggtcaaataacttgtaaatgatggaaacaacatgaccctttagttgagctcttaactaatacacttcttgactctcaagaaaagactgcttcttttatccttatctttaaaaagcatttgtcattaacatgaagacagaaacatgggttgtcccctctctctggctggaaaatagcacagaagctctatttcacttatctcagaactcttcccgggtagattctcaaagagggtattctttttttttttttttttttttttttttttgagacagagtcttgctctgttacccaagctgtgcagtggtgcaatctcggctcactgcaacctccacctcccaggttcaagtgatactcttgcctcagcctctcaagtggctgggactataggcatgcaccaccatacctggctaatttttgtatttttaaatagagatggagtttcgccatgttggccaggctggtctagagttcatgacttcaggtgatctgcctgccttggcctcccaaaatgctgagattacaggcgtgagccactgcacccggctgtcaaagagggtgttctgagttccaagccttttctctaactctcatatgtttagaaaaatcatactacctaattttcattgttttttctaattataaaacatatgctaagtatgtcatgcttggtgactcacacctgtaatcccagcgctttgggaggctgaggcaggaggatcacttaagcctgggagatagaggctgcagtgagctatgatcatgctactgcactctagcccaggcaatacagtgaggccccatctcaggaagggaaacaataaataaataaataaataaataaataaataaataaataaatgtgtgtatacacacacacacaaagtataaaaaattcacaacgcatatcaatgaaaaatgtggttagaaagtaagttatttacttaactcaaacccaactgttaatagatacttctagaactttctgtgcctagaacttgatctacatattaacagaaacaaatgctcacagagaatagatgtaggatatgtgtgtatacatgtataatttgcaaaattgagatccttctcatagttttctgcaatgtcctccccttcgttattgttgacttaacagtagatcagtttcaatctatacgagtataacagatgaatctgtggtattttttttaaatttaatcagccattttctttttctttctcagtggtacattaaaacatggtgaatctcaatgataggataataaagtcaaaatactgcatttaaaaactgactactgttggttaggaaaaccacattatcttagattttccagaatggtttcaaatgtcggcttttttttttccttttcagaaaagctagtatttacattttataaatctgaaagactttcctgtctctctgttctcaaacctaattcatacaccttgcaccatggaaaaatattaacttgcgcattacagacctaaacacaaaatgtaaaaaatgaaaatatttacgactctgtgttaggcaaagatttcctagctactacagcaaaagcacaattgactaaaaagaaaactgataaatgagactttatcaaaattaagattttgatggagacaatgaacagaaaagccagacttagagaaaatgcatacaaatcacatatatgataaaggaattatatccagaatatatgaagaagtcttaaaacaataaggacactgtagttcaattaagaaaaaaaagcaatatatttatttttaatatatttatttttaaatatatttaaatatttataaatatatttaaatatttattaaaatatttaaatatataaaaatatatttatttttaatggttaaatatgctctttgaatattatgtcataatttctatataccataatttagttgtctaaacctttagggaaatgattaaccttatgcttcctcaaactgttgagaatcgataagttggtaataattaattacctttttatgcaaaacttattaaaccttattaaaaaataccatcagtgggtgatcaatcccttaaatgtaatttacattggcaactgctagacagagggaaggaagggaaaagaaagagagagagatttaggtagaaataatggtatactttactctataaaatagacttctccattttcagtataggccatctcccagttttcaggtagaggacctaaattatcctctgcagaaagaggtaggtattgagggaacttctgagaagggtccgtgatgggagcagcgatgatgctactattcacaggtggtaatgctgtttcttggagagtgtgctcctcttgttcaccagaatcggctgcttaatcatgtgaagaggtgagagagagagagagagaaaaaaaaaaaatggtattcagcaatcataccccatacccgggaagtatgcaactatacacatctatattcttaaatgctcttatcctttcctaattcctggccattaactattacttcgatttcatttagatgtctgtgccttaattagaaagcatcgaaatgatcaatgaaatttattttacttaaaaagaagggggaaaaaatcccaagtaatgcattgctcacaatcttggaaatgtcaaagaagaaaccaattcatgactcaaactcttaaactaagaaggccatcaaaacacagatggatctgcaccctcattccataggtatcatttgatttcattagtcagaagatgtttgggcacaaaaaagtatccagggtgaaaacacagacacagtggcattactgtccactcttgtataaacgattttataagttatttttatatttgtataaatatttttggtagacactggcaaagatcaaagaatggttaattaagctgaaacgtatacaaaagtttagaatatggagagagctataccagtgagtcagattggaacctcttttgaaaaagttatgttcctgtgaaaaccaagagttacccccagaacagtatcatgtgggtggactgatatgacttgagtcttaaaagaaggctcgaaatacttgagtctccttgccttcttattaactagaaacatcaggggtgatgtcatcaaagtatccccgaatggcattattgacattctggttgaatttttatagaggccgatgatattaaatgtcaatctccacagggctttaaaactgaataatcagggtatgtagtgaatttctatctcccacagtaattctgtagacatttctgatttagcaaaaacagagtgaagaatgataaaaggctgttttcaaagctttctctgatgagaagctcccaatgacacacatgagagtaaaggtaatctgaaagctggatggaagacatgccaagcctactaaactaacaccaccaccaccaataatctaccacccttgaggaggctgcctgtaggtattcccagccctgcatctatttgctcttctcctgctagcaccactcaggtatccttgtggtgcccctccccactccaggtccacatggtccaggacgggacctactcctggctctacatcatactccttgccaatcaggagtattctatcatttttgtctttgttattaggtcaggaataggtacatgatctaaggcaaacaaatttgaatgtcagacatggaagatttactggaaccatgaagccagaggtggtcgcttgaggctggagcctgtttgctaataggttctcatgctgcaggtgctggagccatcttgacaaagcttgacatgacctgccagagaattaagtccacacagaggaaaggagaggtgaaagatgaagaaagtcatctaatatcactgactgagcctctgatctctgatttcatacttgaaatcaaggatgtccctcattttgtttgcttgaacccccaaattcactttcctgcttaaaccaatttgagttagttttgcaacttgcacccaagagtgcagattaatagatcaactataagtaagggaacagaaaggaattaggccaacatagaagaaaaatttagaaattactaatcaataacaaaataaattcaaaacccggcaagaattaaaggagtcacctttaattctctagaagccaacaaagattcatttctggcatatctttggaaggtagacttttcacacttaagtgcataaaagaatcacctggagagattgttaaaatgcatatttctggctctgtcctccaggaaacaggtttggggtaaggttccaaaatgtacactttttaagtacccaggtgatgaatattcaggtggtataataactacattttaaagacaaagacactaagagttctcccatgaactaaaagaaaaaatgatgtagaaaaccaattgtttaaaaagttctaatttcagttgggaattactctacctgcttcttggtttgaacctgtcattttccagaatcaccaggacctccagctcttaggacaggtgttgccctgccgccaatgagcagagagtggtgcagtctctggctacacactcctccgtgcaccagtgccaggccagagatgcaaatgagacgtgtagagagtgggtctaggctgaagggagctgggcactcagtgccagacagtttgtgccctggaggagagtggacttggggttgccaaacttctgatttttcaagacaagttggaaatctgtatttttatgtaaaatctcccaagttttcaatcttaatttctttaaaaaataatgcagtatgacatcagtgaaaaatgaaaggtcatgattacggacactgaccctggagccacactatccgagtttgaatcctggctttaccatttactgatgtgggcaaagtacttaaccttgtgtgccttcacttgcttatctggaaaatggggacaaaaacaatctctacttcacggggttgtggggaggattaaatggataaggcgcttagaatagtgtctagcacatagtgagccatagtaggtagttgccagcagcaaaagtacctctatcttcatcaaaattatgattaattttgtcttcaggccagacctgtcccccagcctgcaaatacattacaaataggtagaagaaggataggttataacatcaaaccacagattatagtcttgtctgcttctagctgtgtggctttaactttctgagcacatatttctcgatctgtaaaatgggcataatgtacatggcataagaacagaattaacacatgcaaagtgcctggcacctggggcatgctcaatgggtgcttgggactgagacctcttattgcaactacaactgtccaaactcggtgacagccttttcaattaggaggcagtaaactgttaggatgataaggagaaagaataatttcatttgaaaattttaattaacctattttaatagaaactggatataacaggaaaagggtagtgccactacatatgaaatgagatgcactcaatttaacgctgagtgtctacatgtttacaaaaaaaaaaaaaaaaaaaaaagtcctgccaatgttcccagacaatgcgtgaagatggaatattagctctctgggaaaatctcttagtaattttaatttcctggaggaaaaaaaaaaatcccttcagcaacgagatcttactttaaattatccaagtatttgtttttattttatatgctttccatatcttcttctcagctcaacagaatctgaatctcattctctgaaagaaaatggaaagtccaaaaatgagctgctggcacagacacacggcagactcaagaattcacagccttagtcatggttttgactctgacacatgctgtgatttcaaaaaaatcttttgttgggcatggtggcatgtgcctgtaatcctagctatttaggaggctgaggaaggaggagtgcttgagcccaggagttagacaccagtctaggcaacatagtgagaccacatatctacaaaaaattaaaaattagccgggtgtagtggcacgtgtccatagtctcagttactggggaggctgaggtgggagaatcactttaacctgggaggttgaagctgcagtgagctgtgattgagccactgcactccagcctgggtcacagaacgagaccctgtctcaaacaaacaaacaaaacctttcatttaatttaccaaagatttaggagcacagccaccactttcttactaaaggttaccagtgaatccaaagaggacaggtagaatggaatactggaacaagatggaatggggagacagggaacctggttttcccattgttcagtggtgtaacaggtacacagtccttcagggttctcatctgcaaaactgggaagttaatatatggattgcttctctctcaagattttcaggaggtttatggaatacacataaaaatcgtttgtaaaacagaaacgaacatgaatgacatttttattaatagtaaatcagaagcttccaagcttttatacacacacacacacacacacatgcacactcactcactcttggggacttttcaaggtgacttcaacaacataagccaagtcaaagaagatttctgaagctcgttttaaattatacatgcttttaggtttatgtgtatctcccactgtgtacaaccaatcatgatctctgaggctccataaagctgatgaacttgatttaaaacacaaatagcatactaggtgtgcactcaggctgtggaatcagactttctgggttgcagtggcagctctgaccctccctcaccagttttgcgatactggacaaggtatttgacctccctggtatatgcataaagaactcagcaaagtgcttgccatatagtccatacttgagaaacattagctcttatagaaatgattatctcttaactttccaaagcaatgctttatcactctctaccaacaaaaaagaagtgtcagcaacctaatgtttaagaatatcagggattattgggaaaaaaaaaagcctagaaacatgattaagaaatgttttgatgtctctcagaggtgttcatgaatgaatctgttactttttagttgtggtgatttgttacacattttctttcttctttcttttttttgagatggagtttcactctgtcacccaggctggagtacaatggtgcagcctcggctcactgcaacctctgcctccggggttcaagtgattctcctgccttggcctcctgagtagcttgtattacaggcacccaccaccatactcagctaatttttgtatttttagtagagatggagttttaccatgttggccaggctggtcttgaactcctgacctcaggtgatctgcccgcctcagtttcccaaagtgctgggattacaggcatgtaatccttgttacacactttctaagttgtctctaataaacacaatatttttgcaaaagtctttgtttgtgtatatatctgtgctttggccaacagtctaactctaccttcattaagcccacataggaagtgttctttctcaagggctctttttaggtcaataatttgggcacaatttgtagaagactgtcccattgctttgtgttcacagtcagttccatggtgagcatctgggatgactgctcactgttcagcttctgccttaatcaatgactgcagaaaggaggggtgggctgccttcccagatgcttctggccaataggctccttgatcttttgtctgcacagtcccaacgttacttaggcgtcttagtgagacataccttcttcaaaacactcaagcaaaaggcagctaagatagaaacagcagcaagttattaaaaatatcctggtaaatataatatttaatggcttcataatatttctacattttgatatgatgctcatgcctttatcatagctggcccaagcagaagccgacacctcattatgccactgtcactttacgtgcaaactggctggtggattcctatttaatgtggttcagaacacaaaatgctttgataccactagtttcacatacttatggactgggtagtgttaattatttgaaagatttagcatgagttagtgtatgacagattgtcagctgtcgcaggtacactgttgtaagtgaggggacagtcaacgtgctccatacattgtgaagaggtcccatcacgtgcatatctcaaggccactttttcctcagtgcaccctattggccttcttggtatcagacaagaacgtgaggaacacaatcaggtgtcacttggctttctgttttgtgtggaaactaatcatcagactgattttggccatgatgatctgggcccacaagttgttctaagatgccaggatttcaagtggggattttatgaggtcagattttctgaggcatggcttctagagagagagattgatagtagttagaaacaggaaattgcatctagacttacagtaaactacctctactttgttccttctttctaccaaaaaatctatttaataaatagaggacaaatacaggcacacaagcttcttggggaccacccaatctgcttggcagaactgttttgccgcacactacccccaaagtcttctgtttctgtgaccacaactatggtttaggttataccatgatttgctattcttatttatcaaaatatcaaggcattaaagtatgagattttttgaaagaaatgttaacatgtttcatgatctgttttcattttggtaagggccactataaacagatgaaagattcctaaatgaatgaaaacagctgatttcaattaaaacataggtacaaggtggcaaatttcttctagatattacaactattgggcaggcactggcctaacccattctaattgagaaaacagaaattttcatggagtcaaattcatacagctaaaaggggaaactcagacatgatccaatcctagcgagtcattttacatatggatgagttaggcataatgtttctaaaaagacaactaccaagagccaagccagggtaacaaacaaatctcctctgtctttacctaacacttcttgcacagatgtttggctatcctactgctatgacaataaactcatccaaaaaattttatttccatttgataaattttagtcctctgagcttagctaataaattttaaaaaacctaagtgaggcccatacaggttgcaaacagcattcataaataacaaacttttcctaaatattctgttagagttggtagcacaggggaaaacagtccactcatctccaccttcattggagctgatgctaatcaaacaatgaccaaagtataataatgtgagaaaaggccactatgggagaggataatctcatatgttgaaaacggataacttattcatggctataactctaaaatattaaaggcaatatttaagtacaataacaacagaagaaacaaggtgttcgtctaatccacaacactgtagactgaagttactcctatcttactcagctgttacatttggagttactatgtaaggtcaaatcttcatatagtaaaaaatattcttgagctcttctgggtcactgcactaacccaaggaacacgcaacattattattattattattatttttttttttttatttatattttttgagacagagtcttgttctgtcacccacactagagtgcagtggtgcaatctcggctcactgcaatctttgcccttcagggaacacacatcataccctgcaaatggtaccccctggagttgtgcagtactcagcctgtatggccttacccaaaggccttgtccttgaaaatcccttcataaaatacaacatacctaagctcggaggtagacagccctgaatatagataaaatatatataatatagtcagtaatacataggctatataatatagaatgcatatatagatataatgttagaattttacttttccatctttctcccttttaaggcatataacaattttgcgtaagttaactgaacacataatatccttccattatatctctgctttcaaagatataagaggatgctgctggccttctatacagcatcaactgacattaaactgataaaacacattctcatattttgcttcatagcaaccagccataatgatagagatgctgcaagttaccccccccaaaaaaaatcaatgaacaaaatacagatatttatatacatatatcattttgaagagaaagaaaccatgctgatttctcgtttgccttcttcatacattcacccccagctcctttaaggtattctgatgaagttaaaatattcttgtaaaggggcatgaaaagaagaccagggaaaggaccatctcttctgcaagcactgtgtggtccaagtttgaattttggcgactctacaaaatccctcctgagaacagcatccttttcaaaactctatgcaaaagcctcctcgtcatcccttccccaggtccattgagggcaacatgatctgacctttacctgtaaagctgctgttcatttcaggaacgtcatcctcctcctcattctccgcgtggactatgccagcattttgcatatcattgtaggacttggttcgcttcggggtcgactgcttagagccagactgaaggctgtgcaaggcatccgtcgtgatcactttcccactgactggctggctaggaggcttgggtgtcccataatagtttcctaggtgatggagagacacatttgcatgtttcaaaaggaatactttgtgtttttttttaagacttcacatccaaatctctaggcacattaaaaaaaaaattaaactagaaaaccagaacaaactgtattttatttctggagtgggttagaagagatatctttcctatccagctagacacagtaatttcagatgggaagaggaaagctgtattgttttagtgcaaacaacctactagggctaaaaacaaaggaggctatgctgaatagtaaaccttcctcctcattacatttgaatatcaattggtcatctttttacatatatgcaccagcataatgctgaatccaatttagagcaagcctcacagaagattaaaaaattcattactgccggcatccttacaggcctaaaaagttgaggtcactttcccttaataaggggactcgtcaagagggaaccagggcaatatttaaaaaggaggacagtaaaccccacgtggcgcctctttagctgaatggcaggcttgactctcagagtcatgcggggtaggaaaaaacccttgccaagctttaacagaaaaccctgtgtcaatggtggcacccagtatgggtcactcttccagtagtggcccatcttcactttcagccactctttcccagtttgatttaggtcccactatagtgtgctatgtgactctcacttgtacataaatagatttttacattttaatttttttattttaatagatacatatatttttaatttgccatagagaaatctcactggtaagttatgataccaatataaagtttgcctttagaatttaagaaaaaaagcaatactttaaaaaattgacttatttttcacttaaagtttaaaaagacagttttatataataagaaattaatcagctgaatacataatagggatggtagtaataagagtttccttttgaaaagttaaaaagtaagctatttttttaaagttattttaaagataacattaaataaataatacatgttctcatatgaacaaaatcacaaagggtggttcatcaagatcaaagtttgaaaaacacagttgataatcaataatattcagcggctacataataaaagacatcaaccttagaatgccatcgatccatttaccacttcacatcttttagagtaaggccaggaagacaggaaatgattctgagatgctggatcaatcctaactaatgtttgtaattctatgcttagtaaaacagaatttgtaaataataataaatcctgtacacactgtatcttcctaaggatccaaccccattgtctaacctcagtacatagttacataacaaacacattttattacacaagcaccaaaaaaaaaaaaaacacaaaaaaccacaaaaggagacggtaatagcctggtctccgtgagacatacagataataaagaatttgcttctcagcagggtacagtggatcatgcctctaataccagcacattgggaggctgaggcgggctaaccacatgagctcagaagttcaagaccagcctgggcaacatggtaaaatcctgtctctaaaaaatatacaaaaattagccaggcttggtggtactctcctgtagtcccagctacttgggggtgctgaagagggaaggatttcttaagcctgggaagtcaaggatacagtaagcagagatcgtggtactgcactccagcctgggtgaaagaactagatcctatctcaaaaaaaaaaaaattgcttctatcaggctttattcttataaataaggtttcttttttttttttttttttgagatggagtcttgctgcatcacccaggctggagtgcaatggcacgatctcggctcactgcaaccttcacctcccaggttcaagcgattctccagtctcagcctcccaagtagctggaactataggcatgcaccaccacgcctggctaacttttttgtatttttagtagagacgggatttcaccatgttggccaggttggtctggaactcctgacctgaggtgatccacctgcctcagcctcccaaaatgctgggattacaggcatgagccaccatgcctggccaataaggtttcttttttaagataaaaagttttaaaattttttaaaatgttttttgaatcatcaaaatttatagagatacacacccactttctttgagaggagtgtaatagtctgtatcagcaggaaaactcaacatacacatttttttaaatgcagtacatgaaagagcatcacgttcaaatttgaagggtgccaggtagaaacctgatacgcacattctggtggcttatactcaactcaatcattcaagtgttttcataggaagtaatctatccttatcttcaaaaatcttctttcaggtttccaacttacaggcgctagaattgagtcgaatcagcttgaagaaaggcattccacatgtgtctttaggggctaacacttgagcaaagaagaaattagcacgtgtcaaacaagaaatgcacttaatcttgcatttctacagtggttgtatcaaaggatgtctcatgccttcattgaaggtgtaagtaactaggccaaactgttaactttctcattaactgaagactctttagtgaagtttaggaaagtatgatggttaactattttaaaaataatctgcatagtgagaaaaaaaggagagagacaaagctctaatgaatttaattttcattccttaatcattattatatcacgacatcatgtacattttcaagttagatgttaaattaaggccaatgtctataaataagaaacttctactgaaagatgtggaacccctccctcgtaatttttatatgcataatttcctaaccatatcactcagtttcagtgccattaaactgaagtagcattcataaaattattaatcatttaaaatcaatgaaaacttcaacatctgcatttatggcagaaataataagtgcttggaaaataaaagttccacttaactttgacaaatatgtgtggattttccattaggtacctaccctcacttttcaagttcaaaatctttcttaagttaataaatgattagcagatttgttaatgcaattacaaacaacccaaaacaatccacttgttcacaatggtttcctgtttctgaaaattagtttaacattgaatggaggcagataaagtagataatattagattgaaccatatgaaattgctgttgtagaagatataaactgtcaaacataagcaatttcactggctttaatctaatgagtggcccatgagcaatactgcagagccttggcacaccatatcatggggtaaaaggcttggaagagacagctcagagttgaaagcccactactaactaactggctgtgtgactctgggccagtctttgtccgcctttaacttgggattctaagagaacctagtttacacctagaatagctgttaggaagacaaaatgagacggtctgcctttaacctatgctgaagtctgccactatggtgagggtagataaatgctacctaaagttgctatcacatgttttcagtctttaaaatgacacccatactacattgttttgaggatcaaagagatcatgtatgcaaagtgctgcacatggtaactgagcactaagcaagcaaacctgtcaataaccaaataaccaagtcttctaacactcagtctctctagtactttctctgtgaaatgggaatggtagcaccagctgtagcaacctcataggattattgtgaaaattaactaatgcagagttttcaaaggtactctgtaaactataaggtgttaaatatgagatagtgttataattatccaaatctctccactatttcttatttcccgtactgaaacctacaacctttacagaaaagattctgtctagtggttttctaactgcagagtgttcaaactttcatacgccactgtttcaaaataatttggattagtgaccaacatttaaaattagaaagcttctagttaagtctggattctcaatgctgtttgacaaactgtaaagtctggttccagggactccatctcttatagaggatgttgaaaagcaagtatgtgtctaaagccaattcacatgaacatactaaatcaaggatttctgcagagaaatttttgctcctcctcttggttttgcctgacccttgacagacaaagatcttggaccccatctagaacagtgccctcaggctgctgcaatgcaagggcataggcagatacaggggcatgagcagaggcatgagtagatgtaaaaaaaccttaaacttcaaaaagtcttcaataattcacagattagcctttgagtgaattgatttttggagagcttgctttcggccctgggcttttggacaaaaactctggctgtcttatttcaactctggctctcttattctgctgtgaactgcccttaccgtgcagcaatgggcaggatgggtcatgcttgctccagtttgccacagtcaccagtggtcttctttgcctctatgcaccctcttacctgacctgtctggcccctcaggcatttgagttcatgactctaaccttccagaaagtattccacctttgcaatggtttgcactctcatcacaatcaagcaaagtctagccacagcagaaacacaaaccttacaaagtctagccatgtagaaacacaaaccttacagacagtatgcgcgacttaacagtattaaataaaaatcatctgaaaaattgtaagtgattaaaaacttaattggggctatcacttggcaggctgcacagtgtctaggagccgtgaggctgattatcccacaggctctgcgttatccaacacacgtttcctgcagtggctgggctccctcccaagtggaaacttgttctctctgctgctattttcagaactggttctacaacaaatctcaacagggagggtagccagggaggaaagcggagggcaaaggaggacttaagaggaagccactgctggccttaattaacaagcaaaatctctggccaggacaaagccaaagaaaatatttttctgacacacatttaaaaattaataggcactgcaaatcaatttttagggctttataaaatatttaaggaggattgtaaccctggaatttaagctaggatgaatcaaatctatatggctttcaaattatacaaatttactattcattcattcatttccttacagaaaacctttttaatgccaggcatgggaaatacaaagtaaaaattggactgaaacacgatcttcacaaccattctatatggcatacatcagttttgtcaagcttcaatgtgcaaacaattaaattacattaagtaatgatcagggtgggcctgagatccatggatcacactgtttgtgtagcaaagccatttgggacagagaaaatcattcctcttttgcagatgacaaacataaaggcccaaagtggcagaaacgcctgccatggagttacatggctggtccaaggtaaatgggggtgggaattgggggtacttgtctgtcttcttcctatgagacaagcttttgcaaataagcctgagaacaggatggtagtgaccacctatggctgggaatctacagcatgcattttcaacggggcaatatcacccccaagggggcaaaaattgttttcttttttgagggggagagaggtacaaaaaccttactctctttatgtatagtgcaaatatgtatagagtacatgaatacatggacatccagcatatctgattttgccttggcctcacggtcctgagtggtctgccccatgcccactctccaagcacttgtcctgattgccttcaccttgttcttttcactctgacctcactggttgcctttcagcccccagcatgtaaactgtgcccccttcccccatctcacagctcttgcacccactcctccctctgctcctcaccctgttactacctgctcatcctcagcaacagtatctctgaccccacagactagatcaaagctgtccttatcagttcttatatgttctcaaggaaccacatacctccccttcctaatgccctttattgtatatagcagactgtttaattaatcagtacctgtcttcacctctagactataaactcaaagaggccaggagccacatctgattttgtgtaccactgtgttctcaggcctgacgcagtgccaggcacataccattacccggtaattcactgcagaatgagtaaatgaataaaggcagatagtgcacatgaattccagcctgggatcctcctaaaaacctgtattgtggatccagtttttaatagcatgactcacaacactttctttccagtcggtcaattacatttgaattaccaagatctgcatcacttcactttgctacttgcttgctcagcacatgatagttccttcataaaactgcaatactttctttttactcttccttttcctacctgccccaccctacaaaaataggatgttcatgcacagaaggacaataaaccactgttctataattagcagtttgttcttgccagtgccatttggtttctaatacaagaccaaacaggagaacataagagttttacgaccctgagtgaggtaagggacctctctctcttcagcctcagttcacacagtataaagacaaaaatcatggcaacctaataggtttttgtcaagattaaattagataatgtgtataaagcacccagcactgtgcttgacacaatgttagcctataatcaactctgccagtctccaatcaggcctgatgttgtagatagataatagggttaatgtgtaaaagagtgtattatcacaacacatattcaaagaacaacattttttaaagttacctttatcgtgcacatattaagtgtcactacgcatatattcacttactctaatctttataaacaatcttagagaaaaaaaggcatcaatattcccattttcacataaagaaactgatatttacacaagtcaaagatgatgactggcatttaaatacagattagtctgtctctgacatctacacttttaactccaggaatatttggggatctctaagcagggaattaaagaaaacttcgccagctccccccatcttcataagcagaagaacagccaattatagcacagatttcatttggtcactttcattatcaacagagaacattctacgacagagtttgccaacagagctcatcacaacagactgcttctaaggcctgccaaagaacaggactctagacagtctcgctttctttaaccagaaacaagaactctcttcacccctattttatctctgtgtccccaaaaattataccattggcagctgcctttttgcagaccttctaggaagcaaaacaataacattattgaatgctgacatcctcttcctaattaacatgcagaaatatgcaacccataactccaatttgaaatgtcaccctggcactgcacttctatgctgaaggaaaacctttgcaatgctcaaagtgtataatcagcctcttctacccagaggcatttgtaaaacagccatgtctggatccccaccctccactgaatagttcatcccttgtaaactctctcctagagaagtcccaagggctggctgaggcagtgacctgtcttgcagagcaaaaatgtcaacagaaaaaaaaagaaaagcaagggaaaagggaaatggttcagctgatttattttaagcaccatatcaaataaataagctcagtgccacaattaggaagttgggccaagttggaaagatgtgcttattcttgtcttctttaccttgctttgatgccaattctgttcagtgacagaatgaggagctggttcaaattgtaaagcagagatcaatgacaaactctactaataacttctatgccttgtgagggatgataatcagattctttacatcgccaggaaggggctctactctgttgggagtataatgctactctcagcattacagctgtcggtggatagaaagtttcaggatggagtccctgcccggcaaacctaccccaattatagtattttttattttcacaaatggtaccactatctatccagtaatagaagacagaaactaggagttatcttaggaggattgtcatcatctgtcttttctacctcgttctcacaataaccaatacattaacaaattcagcttttcacataaatatctccagattcagctgactatttaccaccaccatcaccaacgtggttcaaagccaactccaactgtggttgccagatgaaatgcaagacagggtgttccgcgtttttatttgctaaatccagcaacctaactccagctcaaccatcagatctcacttcaattactacttctacagaggtactttttcttgattccacagacatccactctccctgtcttatggtctcctttaaagaccttcgcacacttacaattggatattcgtttatttaaataaagtgtcttgttcactagacatttaagacccataaagacagtgaccacaaccatatctgcttttgttcagcattttatctttaatgaataaatgaatgaactcacaaactagtaactgaggctacaaaagaagcattacttttcaggcaaagggaaataaaagcatcccagtcctgcaacatttggccaggctatgtccctaactccctgaagtatcttaaagcaagctctctctggatttcagttctatcatctgaagaaactaactttactgcatttccagctgtaaagtcctacaaccgaccaatgtaaatcaagcaaatattgggcctgaaagagaattctgaaggttactgggccttgaggcttcactggttcactctatttgtctgccatcttgcctgtcatagaatgtatccacaaaagaagatcaccactcctctgcataacatcctctttgggaagattcaacacgatgattcttttttaaaggagcttaactcttaagacctgctttgctttgtgaagtcagctggtgaggacagagatcttgttgagcaggtcctcaaccttcctttcagaagcttttattctaaaactgaagccaccagccatgtgtggctacttaaatttaaatgagtttatgttgaattaaagttaatttaaaacttggtttctcaatcacaagaaccactggctgccataatggacagtacagaatactgaacattcccagcatggaaggaagttcttacaggatagcagtggttctaagggaaacagggtgtgcttgcttcccctccctttctagaagccatccttctaatcctctcttggttcatcatcacatcgttctctgtggattcaggccccatggcccatgctgattactaaattcaaacaccatctcccagcctctcacctgacctaacacagtcctctcatagcttcgcctcctctagggagtctgccaaaactagatgaagctttctataagcttctggagcgctgtgtagtttctctcaaaacactcataactttttttcttttttttttgttttttgagacagggtctcactttgtcacccaggctggagtgcagtggcacaatctcagctcactgcaacatctgcctcttgggttcaagtgattctcccacctcagcctcccaagtagctgggactataggcatgcaccaccaagcccagctaatttttatatttttttttggtacagaggggattttaccatgttggccaggcttgtgtcgaattcctgacctaaaatgatccgcctgccttggcctcccaaagtgctgggattataggcatgagccactacacccggcctactcatcacttttcttaaaattgtttacattcattcattcatatattacacagagtcttgctcctgttgcccaggctggagtgcagtggtgtgatcttggctcactgcagcctcgaacttcccaggatcaggggattctcccacctcagcttcccgagtagctgggattacaggtgcacgccaccgtgcccagctcatttttgtatttttttatagagatggggttttgccatgttgcccaggctggtcgcgagctcctgagctcaagcaatcctcccacctcagcctcccaaagtgctgggattacaggtatccgccaccacgcccagcaaaattgtttatgtttaatctgcctcacaagactgagtgtgggaagagtgtagactctgtggccagagtgcctgaatctgaatcccagctctatctttgatttaccatgtgaactaagaagagattactggcatttctgggcctcatactcctcttctgtaaaatggacataaatagaacctacctcataggcttgttaggaagattaaatgaatttgtgcatataatgcactttgaagagcacctactatgtgccacacaagccctagcaaaaataattaattaaaaaacataagcaccttcaaagtcaggtagttttggtctactgccctgtacatcatatcccttgcctcacaaaaaaagtctgacctgaaataaatactcaataaatatttgttgaaataaactatatatgcattaaaaggcttgctttaaaactgtgctgccagaaacttaccctatagttatgctcataattgcgtaacaatatacttgaagcactgtttataacacgaccaccaaaaacagaagggggaggtgaggcaggggacatttaaaatgtccatctgcagggggctggttaaataagttatatatttatatacagatagacagatagatacatagatagatgtagagatatatatatactcattcactgggacactatgcagcatttataaagaatgaggtgaaactgtatgcggtaatgtggaaagatctccagggtatgttaagggcaaacggcaataacagagtgaagtaaacgagatatacatatatgttgtgtacatataagttttctgaatatttgcactagcatctttaatagtggttacctatatggaagaggggaaacaagtaggacttagctagttttaaggcttttgctgtaggaactattccatcatgtacacttattactgttacttaaacatttatatatgtcttcctttaaagagtgctttgtgttgttgtggtagacttttcctctctggaaccagcagaggtctggagaaagcaatttcaggaggggaaaaaagatggtgagtacctgggaagtaaataaagacattttactggcaaatctgctggtttactgactagtagaggggaaagggatccactacaggagcaattttgaactaggtgcgtgtaaatacaaaagctaatgctgaaggagagcttacatgtgtcagacactctgctaagccctttccaattattgtctcatttagccctacctctgaggaagcactattattatcctcattttaccaatgggaaaatggagacatgcagcattaagcaacttgccggagggcacacagctcaatagcaaaggggctgagaatcaaactcaggcagtgtgacagcagggcttgcatgcttgttagtgtccaccaatagacagcagccaccatcaggggacttgtccaggggaggcaaagacagtggaagttctctaaatgtctttccagccctactccgatgagggtatatggcatttaataaacattccatttggctctcagcttttaagagtcaatataatatactctggtcagttccaaaaacttatgagccatctcggccaggctcggtggctcacgcctgtaatcccagtactatgggaggtcgatgcaggcggatcacgaagtcatgagatcgagaccatcctggccaacacggtgaaaccctgtctctactaaaatataaaaacttagccgggcacagtggcatgcacctgtagttccagctactcaggaggctgaggcaggagaatcgcttgaacatgggagggggagggtgcagtgagctgagactgcgccactgcactccagcctgggcgacagagcgagactctgtctcaaaaaaaaaaaaaagaaaaaagaaagaaaaattatgagccctctcatatggtaaggaaatttcgctgctaataggccaaaggctgaagaacgctgtacaaatgggttagaactggaaaagattagtcctgtgcctaagaaaattccaattccaaaataactatgcaacattcacaaaggcaccgttttctacaagacaatcagacattttctgaaaaccattcctctactgctatacaccaggaagttagcttcaagtactaatgggttattttccttagcttcttagttatatctaggatattcttcgggtttttaggaaagagtgtaggatctgagagtcacactgagctgggtttggttccttctctagcattctagaactggctgtgcaactctgaaatagttatttaataccacttggcttcagtgtccccatctaaaaattcagtgaagataatagccgcctctgttgcaatgataaaattaaatgagaaaaagaactgactccacctatatatcatttgttccattaacatcgaataaagtgagtttactttccatcttccaagttaaattggagtctaaatcacaagtttttcctttccgacccaatcctcttttgctttgtacaaccactcccaccccagcctctccaaaaatgcaaatagatgttttatatatttgacgactgaagccccccagatgggcataataactgattgcagatgaggacatttctctctctgctaaccaaagaggagtcacacatgctctcctcttcacatgtacaacatgtgaggacagcatgctgacaacatgttgaagaagctccttgtaccttcccgcagcccccctcccttccctctatacactcctagacctcgattactctcagacccctgcccagcccaccagccacccagtcacatcccaacatgtagtttcaggaaactaagccaactgataattagcaacactcaaaaacaaacaaacaaaaattcctgattcatgagcaggaatttgattaatatacactgtctactgtatattcacaatttggaaaggagcagtatgtacaaagacaatgctccttcccgtcttctccaaagaacatcaaaccagaaacagccatctctaagattcatgatcatgatatgagtgttagtcactgtaacagaagcaattatcacattaaagctataatgtccctaataaaataataatctactttgtatttaccctttatgtttaagtctaatctttaaaatgccccgtgaatgcctaataaatccaaattttaaagagtttgtaaagagatacacataataacttgaccaagttaataatctgtcctagttaatagtatcattacaccacttctgcctcaaataataataacactccaaaaagtaatcaagctataatactgttttcagaaaaatgtgacttttttccaccacatttggctttgacccagcaatgggatctgatcctatggatatgtttgcacctgtatgaaatgatacatccatgtcattcgactcagcagtgtttagaaatatgaaacattgaaactgactcaaatatttgttcagagggaagtggttaaataaattacggtatgcccatacaaaggaattataatttttataattatatttcaaaaagaagaaaaccagaagtgctttattactgaattgcaatgacctattaagacatactgttaaacaaaaagagcaaggtccaaacagcatgtactatatactaccttttggggaaaactgggaagaaatgggaatatccatacaacaggcatgcacacatgtacatacgcatgtgcacacgcatgtctgtattgacataaacttcagaaggtaatcagattatttataatattgaatcctaaatcaggcaggtgggagacaggtatatgaagattacttagctaaatatttttaaaataatttgctttcctgtaatcccagcactttgggaggccaaggcgggcggatcacgaggtcaggagatcgagacgatcctggctaacacggtgaaaccctgtctctactaaaaatacaaaaaattagccgggcatggtggcaggcgcctgtaatcccagctactcgggaggctgacgcaggagaatggcatgaacccaggaggcagagcttacagtgagccaagatcgcgccactgcactccagcctgggcgacagagcgagactccgtctcaaaaaaaaaaaaaaaaaagtttgctttatgaatcacataaaaatacattaaaaaccaatcagtaggaaagtgatattttatttcttcaagattaaaacaacactacttataggatcacattttgtgattaaccatgattcttccttctctcctaataccgcacatgtccgtattaaaaacaaaacacacccacatacttgaataggtaaattaaaaaagaaaactcctagagaaaaactaaaactatttttaaagaactccacaaagccttattccatagactttgtctattattcgtcatattaaggtgaactgaaatctcctgttatttgtttagacctccagattccacaaaacatttttgcctggatggctctggctcctctcaagtacccaggagagaagctttttatgctgtcgtacaagtaactcaccttcataggtgccgacttccagaagagtcccactctgctcgaggtccaagaactccttcacagtcagaaagttatagtccacgccaggcacttctccttctctgggagatcgggttgtgcctgtagcagaaaatacaaaggcacaacaaaccatcaatcaactaaaacaggaagttccacatccaggtgtaattaaaataacctgttcagtaagagggcgtacctaagactctgctgcctcatctgtccagacagggacacagtaaaggcaacttctttctaatacaacacaacagcattctcatttccacactctagtgcctgggaccccaaatgggagagagagaaaaccaagcaccgctgggtaacctagagagagttttataccatttttgataatgcactgaataaaaaaggtgaactggattttatacagacaacattcacagtcagcagcttttacgactccagtaaatactaaaaacgtatccaccttaagctcagagcctaaggggtttgtgtttttatcacaggccttgagattctcgtattcctcaatacaaccggcaagttccaaagccctttaaagaaaatgacacctgctgcataaacacatcaccagagaaatatgattgcctgagatctgtggttggacatctcccagggattaaaatgctgctgctcctcatgtaattaatatgttgggcaaaaagaggccgtccatgaattctgactagggagaaaggacgctgcatttgctagaaaattctccccctgcattaatctggtcatcttctcagtggctaacaaatgtaacgcttcctcttatgaaataaggcagagcatccagagtaaaaaagtcatccagctcaggtgctgggctatggatttatcattttagcccaatctcagtcaacaaagtggaagcaatgagcagaatgtggtttacacataagtcaagaaaggaaaataaaccaaacagcaattatgtaccctgtattaggagcctatgttaaatattatgagacgaaaaaaaagagcaaaaaatgtgacttctgctgttacattcaacagagctcatttagcaaggcattattacctgcggtggtgatttaaggtcaacgttttcctatataataagcaacgatatttccctatgtctaggatctcttcgttgaaatgtaatgcaattaaataaccgactatatgtgcctagtggcgctgaagttcttagcactgtgcagtctctgatcatctgcccatgtgaataaccgcatccacacctacactggatattcacaattttcataagtcaaaaacactcaacacttagtacacactttactcaggcaaaatgtatttttagtgcacataattcttctatctgaaatctgaatattttaaatagctgcaaattgggcataggatggttatagtatagatgtttgcttctcataatcagcatgctagaaccttcaggttaaaaagtctactcttacactgtttcctaatttgttcccgtttcgtgcctcccctggcaggtgatgacaaatcccttgaggtagttcacaacttttaaatttacatctcaagtgtcaggcacaggaaacatagagacagtatcatatactgttaaagaacagtggtctggagtgggaatcctaggttcatggtctgcctctccaacctgtggtcttggacaggttccttagtgtctatttctcagtatccttgtttgcaaaatagggataataatagcacctaatccataagtttgttgtgtgtattgaatgagataatcctttttgagggctttgctcaataatttttagtagacattatagtttatgtttttgttagaatgaattgatagaatcttaccgttcaaatcccagtataataatctgttattatatacatataaatatatctctgtttatgtatatgtgtgtgtattcatggcattatatattgtatttattcaacaaatatttactgaggccccaacacatgccaggcactgggaaaacactggtgaacaagacaaagctcatgccctgatggaatttatatgttactgtgagacacagaaaacaaatatgtatataaataaatatagcatataatatcaggaggaaatcattcttctacagactgaaagattagaaagtatctcagagcaacataggttaaaggtttagacagtgtcttggagggagggagcaagggagaagtagggaagctatattagctaggtgatgaggaagagcctggctaatagaaaaggtgatggggaatgcatccaggcagagggaagggaaaaggctttgatacgggtgtgatctggtgtgttcagggaagggcagaaaggccagcatggttgcggtacagtgatgaaaaaagggctggaaacgaaagcaagcggcaagattacgtaggccatagaaaacacttcatattttattctaaggataatggaatgtcatccttagaatggttttgagcaagggggtgcgttgatttggtttttcttttattttccttttcagagacagagtctcgctctatcgctcaggctggagtgcactggaggaatcacagctcactatctccttgaactactgggctcaagagatcctctcacctcagcctcctgagtagttaggactacaggcacgtgccaccacacccagctaatttttttttttttgtacaaatggggggtctcactatattgcccaggctggtctctaactcctggcttcaagcagtcctcctaccttggcctccaaattacttggattacaggcataagccaccacactcagcttggttttcctttttaaagctctttgacttcaaggagaacaagttttcggagagtagggcaggaggtgggcaagaatagaagcagggggaccagttgggtggttaccatagtgtccaggtgaatggtaatcaagatatggactagaataggacagaagtgataagaagcagtgagatttctattacaaacatgagtattttaaagagctacagcatagtccatagaacagacatattaaaagtaaaacccatcatcaaggtattaagcgccacatgcattagctatttatcctgatgctctccatgccacccaccaatggaggacagagagcatcagggggatggagatgcaccaggataaatagctaatgcatgtggggcttaatacaaagatcaggtgcagcaaaccaccatggcacatgtttacctatgtaacaaacctgcatgtcataggtaagtatcctagcacttaaaataaaaataaattttaaaaagtatgtcagctcatcacaccatgctaggtctatattttgaagacagaactaatagaacttgctgatggattggatgttgtatgtaagaaagacagaataaagacagaaatacctattttgtgacctgggcaaatgggctgtgccatttgcagagattgagaaggctgaggggaaaggttttgggaaaagggaaaatcaaaagttcacttttggacatgttaggtttgaaatgcctaacagacacctacgagcagagagttggagcacagctgaccttaaaagtctgaaggtcagagtagagggtggaatgtaaacttaataataatattaagagtgatcagttgattagtaaaccaatggcatttgaaggcaagagacagaaagataaaatctacagagagagtttaggggaaaaaaagccaagaagtttggattgaacactaagaacttttaacttttcgaagatgagaataagagaaagatcgtcaaaggagactaagcagcagtagccagcaagataggagcaaaggaggagggtgtgatgtcttggagccaagtgaaaaagctgttcagccagctacctctaaaacacaaacagtctacatcacactgggaattccagtgcagtgcaagaatagaatctctttgaaacttgctgtgaaaggatctgtcctaaatatgttctatatggcaactctcatcttcagcctccataccaaagttccattaacttaatccatcttgaaaaaaaatgaggacaaaataaaacaaaacaaaaaatctgttgagtttcatagtcttgccaaactagacaatgttgatttttttctcctgcagccatctttgccattctttcaatgatgttttcagatccaatttgtcaggtttaccttaaagacaacaatcaccctggggtcttaatttcctgagaggattcaaaataatcaagaacgtcaaaaatgctacatttcagcagaaacatgaaactagcagatcccatttttccatgtaaataaatatgcttaggatgccttagagcagcatgggaagggagtgggaaggcgggcaagtctccacccacaaaacgttcagggtttattacccagacaaaacctttccatgctcaggctagcaggaggtttcccagctatcctctgagcagcccgccctgggtctgggccaacctgaccaggctctattcaccgatgttgtggagaaaaggaccgagggaggggaccccgccttctcttttcttgtagcagaatggcaggctgctggctggacacacgcctggcagatggcatttcaaagggttttcaggagccatctgggttgggtacaattattataaaccatgcttctaacaaagccagaagggttacttcctgacagaagacgagtcaaacaaattctaccatgtttctcagggacagcgtactaatataaaaaaaaagaaaaaaaaaagcgaccaggctgacaaactgggattttccttagcctacaatactgccttctctttttctagctagaaattgggccaacgatatcttgcagttattagctttaagctaataataagcacagcgtccaaccccccaaaaaagaaaaaaaaatatataacgctgggaaaaaaataatagcttccatttctcagatgttcacttatgtcccaagcaagctgttaagcacttaatcaatactattattgtatataatcttcacaagaaacacagaagtaaggattattattaccctcattttattgatgaagaagctcagactcagagaagtaacctgcccaaggtcacataacaagttgggcagagccatggtctgtctgaacacaggcaatgtgacagcagcatccctcatccttaaccatcactgtctgatggaacctgtccttcatggaaatgttccatatctgtgctgtctatcctggtagcccctagccacatgtagctattaaaaagtggccagtgtgattaggaaactgaatgtgaacttttatttaatcttaataactttaagtttgaatagccacatgtggctagtggctactggcctggtcagtacagctctcaaccatgagaatatctgagttgccttcattacactacatccagtaccatgtcccaaacaacttctagcactcaaaataagaacaagaaacatacttacctgaaacagcatgacatctcaaacagatagaagaaaaccgctcttaaaaaaaaaaaaacaaaaaactctcatatgctttgaaaaactatctagtcaactccacgatttgttttaaaaattccattgattcctattggctgtggtctctaggaaaaaaaaaatgttcttagatatttgtgacagcatggtttgtagcaaacaaaacaaaaaagaccaaaacaaaagcagccctccaagacacagaaaaaatgagtgtccacgaatatggaaatgattgaatgaaatatggttgatccacccttgggaaaatgttttagctatgtaatggtaaatggtaaagaatggttaaattggccaggtgcagtggctcatgcctgtaatcccaacactttgggaggccgaggtggccagatcacgaggtcaggagatcgagatcatcctggctaacacggtgaaaccccatctctactaaaaatacaaaaaattagccaggcatggtggcaggtaactgtagtcctagttacttgggaggctgaggcagaggttgcagtgagctgagattgcgccactgcactccagcctgggcgacagactgagactccgtctcaaaaaaaaaaaagaatggttaaatctacatgcagttacctgaaggaatgcctttaatgtgcactgaagtgatataaacaaattacagattaagatgtaaactatcactgcatttcattgaaaaacagaatatggcttgttttacaagtttatgagttttatgagttcacatagttaaatgggtataataatactatacccttaacagtggtaacctcaggagggtagcttcagaaatgggaagagatgaaatgattgtttaaacaactctcatgctccaaatggtatcaataggcaggtaactgtcttggcattttataaactgaatgaaatcattatttaagaaatattttaagacctgattcttggatattttattcaagtactttcaaaagtaacttagtcctcacaaaaaaacatgcaaacgacttatagactccagctgaatcacacaaacaatgtttcaaggtttcccatctcatagaaagccagcctcaaggtcaacaatactttacttgccttaccgatgaataggaatatactacaagtagatttgagaaagtggtactattttttccacttgattttatttttaaaccccaaactgctcatcacttaaacagggtcctttttaagtatttaagtacctccaagatttgtactagaatagtgaatatcaacccttcccaccactagataataacttaagtaattaatttgagctgtgtcctagtgagtgtctcagaaagaattagcaatgcccccaaacttcatccagtaaagcttgagtggctatctgcttcttacacacattttatggttcataaacttgcagtgtatctggcttcagagactcctgctgaggaaatgagaaagtgaccttccttatcactgaaatccacaaaccatgactacaaaaaggaaactggactgggaacttatctgcgctatctttttattctagacattctcttgaaatatccagttgaggcagaaaaagaaaaatcctactggtgaaattctgataagccatttcccactgcttcaccttcccaacgccatgcggtttcaagatgttgagatctcactcaacaactgtccaaatggtcttatggccagactgttaaaggaaaataatcagcccacaaagattacattgtcaatattccatgatatcacctgctgttaaattaatcagggtcctgcttgtcaaaatctaacaagacttcaaaaaatgacagtcactgcaactgcttacgtgttaagaacagatcatcattttcctattctaacacaatcatttgcatctgataaatatccagagtatcagttggatatccaggacagcctcatgcagttcattctttagctgatagagctagagcacagtagaatgtattagtcctccaaattcactcagttacctacctctcacacaatttttgccatatatgacaatcagcactacaatttacttgatatctatccctcaaatcaaactgccttttgtggtgaaacagacatcttatttaatatgaaaaaccccttctgaaactgcttttaaaaaaaattaaacaggccaggtgcggtggcacatatctataatcccagcactttgggaggccgaagtggatggatcatgaggtcaggagttcaagaccagtctggccaagatggtgaaaccccatttctactaaaaatagaaaaattagtggtggcaggcacctgtattctcagctacttgggaggctgaggcagagaactgcttgaacccgggagctgagatcgtgccactgcactccagtgtgggcaacatagcgagactctgtctcaaaaaaaaaaaaaaaaaaaaaatttaaacatatttgggtaaaaagtaaatacttagccaccacaaacctattagaatggtttaaaaatgtttctgtaataccaaatgctggcaaaaatatggagcaactagtactcacatgccttattgggaagaatacaaaatggtacaaccatttggggaaagagtttggcagttagttaaaaagttaaacataaatttctcatatgacctaacaatcccactcctaaatgtttaccccagagaaatgaaaacatattcacacaaaaccccatacagaaatgtttagaagagctttatgcataatcaaccaaaactttatgaaaacaaccaaatgtggttcaattggtgaatgaattcactgtggcacatccctacaaagaactactgctcagcaaaactacagatacacacagcatggacgagtctcacatacattatgctcagggaaagagaagccagactcaaagattacacactgtatgattactccatttatattctatatattctatagagatggagaatcaagcagtggttaccagctatgtagggtgggagcagcacaggtaattagggaaaggaggaggacactgttttgtttcttgcctgcggtggtggttgcacgactgtgctttggtcaaaacccatagcgcacaccacgaatggtgatttttactgtgtataattttttaaaaaaggaaacatttagctttacctcaaatggaaaatcagcttcatcctgccataaacagtaagtaactaaaaataaatgccacaaaaataaagccattttgttttatctgtagcctaaggctctgagcccgaggtctgaattatcctattatcacaaaaggggattgacaaacattagaaatatcttagatacctattaatgtcaatttgagactttctgcttagcataaggatttgtcttcgttagtttggactgttataacagaataccatgaactgggtggcttaaacaataagcattgttgagacaggcattttgacacacacctggagtcccagctacaagggaagctgaagtgggaggattgcttgaacccagtagttcaaatccagcctgggtaacataacaagaactgtctggtgagaggaccctcttcttgattttcagacagctgcctttttgctgtatcttcacatggcaggaaatgaaagcccttcccctttttacatggggcattaattccatcacgagaatctgacctttggttaattaactcctaaaggctcctcctccaaataccattacattaggaattagggacccaaaggtgagagagggagacagaagggtgcgttgaagcagaaacaattccaatgtgaaaagaaaaggtgtgtgggtaaggtggtcatggtgccaaggaaagggctgaaagaaaatctatggctcatactactttggagggtgggagtggttagaaaacgaacagtggagagagggggtaaaaatccatgatacaggtaatcccagatgagacagctatgtagactcaaaagggtcacgtgaataaatgtgactcaaattgttagtgtcactaagcaacacacacacacatacactgccccctccccactcccaggtgtgctgtacctccagcagaacaaagttgaaaaggtaagatccttgtcttctgagaacttggaatcagtttgggtctgtgtctaatcagaattgatgcctcattgtaaatgagaaagcagctaaaagagacttgactgattgtcatccctataacacattataaaataaacacgaataaagaaggccagcctcctcctcaggaatcaggggaagttgttgagttatttaacactttatatgtggtaatctacaaatcacttcacaaggaagcaaggccactcagggcaacataaatggatcctttctagaagcaccattttgaataatggggcattctctgtccaaaactctcaactatgataacaaaggtcagaaacaggacccttattttttctatcccagatctcaacacagtagtgtcagtaattgtgtctcataaatggaataatgccaagccattcaacagcaggtgtgtaaagacaattattttattccagctataacttgcatgtttgggatcagcagaccatttcaggttccatcttgcatggaagaacactgtgtgatgaaggtattggaatctcgttttaaaaaccacacctacaatacttgaaataaataaggacttggcatttattccattgtactgatgatttgcaaaagtggcctagacatgagagatgggaagcatctgatctggttttcatgatcctacttctagctcttttctctatagctatgacatgggatgaaggaaaagaagaagttttgagtgccaaatccaagtagctccaaaggaactattcaaaccgtccatgtatccttttcctggaagccaggtgctctcagttaagtgtaaacatgttacctttcaaggagatccacattatgtcaaagaaaaatgtgaaccttccagattgttgaatgaatcatataatacaaaaagagagtatatgtttgtctagggcaagcaaatggttcccagtaataaacaaaaacagcagctcaaggagctgatgtaagaagaaccagtcttgatccagctctgccactaaattaattatgtgactaccttggaacattcccttttatgcactcaatgtccttatctgtaaaacaaaaagggtaactactgctctgactatatcacagaatgattgtgagaccaaatacattcatgtgcaaggatacaaacccctcagcaaattaaaggcattagaaaattatgttcatttaaaaaatctgtatttaggccaacgtctattctttatatgcattatctcatttaatccttgcaacaacactataaagtagttaatattattatcctatgtcacagatgagaaaacatgcacacattatgtgacttgccaagaattacacagctggtaagtgtcaggaccaggacttgaaaccaggtttttgttactaggtgggaacttctgtacacaaagaagacattggggaggggtgggaggataaactagtggaggagcgaggtgcagctgaatttccacagctcttcacccagggttgaataaatcaacactgtcttcatccaggaaacatagcagggagctgatggagttgacggtctgggagaagaaagctggtaaaacccttccccacaacctctttgatcccaaacctaaactgtcaggaactatgtcttactgcctcttaaccagaatactgaggaggaccagaaaacattccacaggaaagtcaacctgaacatgaacattaaccatttttcctcatttttcagggaagggaactttggcacatacaaactcatggaaacctcgcattcattaaagtcaggaacatgagagttctcaggttgtaactgattcatttcaaacagtattaaaaagcatccaggaaataaaggataagaatcttcagcattagatacacatttatcagaaatcaacttttgaggattatccttgaaggcatttttgttccaagagggattcaggaaaccagtaacgctataccctagcgctaaaagttgtctatgagaaaaggggatgagagcagatagactctctccattatggcaggtaataatactttcactttctctgattaattatagcaattgtttgtgtaaaatggaatgaactacttccaacaatttcaaccagataattttcaaaagcatattaaaagaaaataattattttggtgaaaagctgtgattaattaagaatatcaagtttccacaaattaggtgactttgcatggttaatgctaaatactgaatgtttctaatattcggcagctttcttgcttagttaaaaaaaaaaaaaaaataactggggccaggcatggtagctcacgagttcaagaccagcctatgcaaatagtgaaaccttgtctctaaaaaaatttttttaaattagccagatatagtggcacgtgcctgtagtcccagaaactcgggaggctgaagtgggaggaccacttaagaccagcagaggttgagacagcagtgagccatgatcgtgccactgcactccagcctgggcgacaaagtctaaaataataataataataataataataataatagggaatgactgctaatagctacatggtttctttggggaataatgaacattatttaaaattacatcgtttcaatggttgcacagttctgtgcatataatgaaaactaaagaattatatactttaaaggagtgaatattattatgtataaattgtgtatcaataaagttgttaaaaaaactcttacactgcagagatgtaaagatgggcaaaacatgatcactgttctcatgaatattataatttagctgaggcattgttacatttccataaataataataaatagtataatttactcttcatcaatttaacagctgctttcattagtcctcccaatatgggaacttaaagagtgaaatcagcaatcactgaccatgttatgtcgttttcctaaaaattgcagggatctaaagctctttcagaatggcagtccagagaaactgttaaaaaatctacaaccagatttggtgagttcaaatctcagctctggtatttgcaaactgtgcaaccatagacaaggtaaacattttgggtcttggtttcctcatctctaaaatgggaataataataatgcatgcctcataagactgtgtgaggattacatgagataacacaagtaaaatgcttaacctggtcataatatgcattaaccatgacaacaacagtatctgcccacgcccgcccccaacaacatactctgtgcttctaaagggaaatggttatggaagaaggaagactatggatcacttactatatctctaacaaagagcacaggttttctatacataatgcctaatttaattcttccaagaggggtatatttttccaaccttgatgaaattttccatccctaatcaccatttttcaaagtcacacaagaatctatatagctcctaaccacaactttttggattatctttcaataagaaatcacaaagtcaacacattctataaataccctcattctagtcattagccactagcacggatccataagaaaatgcctacttattgaaatataatgtctaaatttgaggatctcaattgccctaattccatgttaaccatgttattcttcacataatcaaagccttctataattaaatgaatgtgatatttattgagcaaatattatataactagatataaaacgagaaataaatttgtatcaaggactaaaacaaagcaattacaatagcaattcaaaacagataaaagaaaaaaggagtttatgcccatttaacaaatacattcgttctcagttgacataggcatgatagttctgaagccttctcaagtatacagcgaaatagtcacgaacatgtaaattttattttcactcccatcaagtatacatatggctacatcaaagtaaacaagaggaaataccacagagtgcaacatataacttcttgaaaaaataaagaagaattgggtacaatactaagcctacaccaaagaaaggtacactatagtactacctgtgcatggtcttcatagtattgaagaaaacttactggggcagtaaaatttctagccacacagcagtatcatgttgaagcaggtctacagagtaagtagcataaaactgaacatatctttccatttgttaacacatgcttttttccctcatatttatagtggtatttaccttgaaggggttttagatttggcatcaaaaactcaaacattcaaaaagtgtctcatgagcaaaggctgagaaacatgagcatttaaatatcacataaaattgtatgaggattacatgagacaacacatgtgttagcctggtcataatatgggttctcaggcagctgatttcactcttgggactctggtgttgttcgtaacatgcttatgttttcccccataaataatgacatcagcagattcctagaaaactaaactacagctttgattcccagccccttccattaccttatctaatgtttgccaacgatctctataactataaatcacaatccaaaaatatatggacttggagcaacggcaaaatcatttagacccagctgattaactgttattgccctcatttcaattagttcatgtttcagtgagcaattacattctcacattatgtggtacttctctggctacaactatagctcattttatgttatggactatatagtttctagatagatgagtcatagaaattattttttttcagtctcattgttaagccaaattaggtagcttttagaggtgattttttttttaacaacagcaacataaaaaacccaattactaatgcttctaaacatttgcttggaaaatgcagacagtgaggaacagaagcctgtgctgatgtgataaacccaagttctggtctttacccacactgactttaaaaataactatctcattagaatactatatgaggtatcaacggtattatcagaaaagtagtggccaatttttaaaaaataaaatcggccgggcgcggtggctcacgcctgtaatcccagcactttgggaggccgaggcgggcagatcacaaggtcaggagatcaacaccatcctggctaacacggtgaaaccccgtctctactaaaaatacgaaaaagttagccgggcgtggcagtgggcgcctgtagtcccagctagtccagaggctgaggcaggagaatggcgtgaacctgggaggcggagcttgcagtgagccgagattgcgccactgcactcctgcctgggtgacagagtgagactctgtctcaaaaaaaaataaaaataaaaataaataaaatcaagtagcttttattattataagttactttgaattattatgttatataaagacaatagtctttaaatagaatctaatagaaattgggccttttcaaacaagccttccttatttcagagatgtcaggtgagtgctttgccttctaagacagtcacattactttaagcctataggattctcattaatccaagaatgcagattatgcctttgtcatctattcaaactggacccaatgtgagtccagatacaatccagtcaatgaatctgtattagagataattttcattaaaaggaaatggatacctttgttgtgacatataaataacaaaagaaaaaactggggagttttgtttttgttgtgttttgtttcatgtgtattaagtgagtgtcattatcacacaatgcttactggttctcactcttgggttccatctgatttgtcatccctgtcaacagcaactgctgatcaagggcaaagagagggcagaggcaatctttatttcctccatttggcagcagggtaagactgccattagcttcctgtgagccagggaagacctggtgatacgatgcatgatcctggagctcttacaagaagttttcaccagatacttgcctcttaacctatttatctagcagttaggctctcattttctgggaaacccacatttttgcccagagggaagcaaagagtcaaagtgtttaattgaagctattgccttggcctccaatgggttgtttcaaaacaaaacaatcaaaataaacaaacaaaacacaggtatttaaatgaagcagtagggaaatccagagagctcctaatctcaacacataacatatgttacatttgggttttgtttttggggaggagccaagatggccgaataggaacagctccggtctacagctcccagcgtgagcgacgcagaagacgggtgatttctgcgtttccatctgaggtaccgggtttatctcactagggagtgccagacagtgggcgcaggtcagtgggtgcgcgtaccgtgcgcaagccgaagcagggtgaggcactgcctcacttgggaagcgcaaggggccagggagttccctttccgactcaaagaaaggggtgacggacgcacctggaaaatcgggtcactcccacccgaatatttcgcttttcagaccggcttaaaaaaggcgaaccacgagattatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagaggagtggttctcccagcacgcagaaggagatctgagaaccggcagactgcctcctcaagtgggtccctgacccctgacccccgagcaccctaactgggaggcagcccccagcaggggcacactgacacctcacactgcagggtattccaacagacctgcagctgagggtcctgtctgttagaaggaaaactaacaaacagaaaggacacccacaccaaaaacccatctgtacatcaccatcatcaaagagcaaaagtagataaaaccacaaagatggggaaaaaacagaacagaaaaactggaaactgtaaaacgcagagcgcctctcctcctccaaaggaacgcagttcctcaccagcaacggaacaaagctggatggagaatgactttgatgagctgagagaagaaggcttcagacgatcaaattactctgagctacggggggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagccccaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttcaaatgaaggaaaaaatgttaagggcagccagagagaaaggtcgggttaccctcaaagggaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatacttcacagacaagcaaatgctgagagattttgtcaccaccaggcctgccctaaaagagctcctgaaggaagcgctaaacatggaaaggaacaaccggtaccagctgctgcaaaatcatgccaaaatgtaaagaccatcaagactaggaagaaactgcatcaactaatgagcaaaataaccagctaacatcataatgacaggatcaaattcacacataacaatattaactttaaatgtaaatggactaaattctccaattaaaagacacagactggcaaattggataaagagtcaagacccatcagtgtgctatattcaggaaacccatctcacgtgcagagacacacataggctcaaaataaaaggatggaggaagatctaccaagcaaatagaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacatattaataatgggagactttaacaccccactgtcaacattagacagatcaacgacacagaaagtcaacaaggatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctcccagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacactctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaagattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaaatagaaaatctagaagaaatggataaattcctcaacacatacactctcccaagactaagccaggaagaagttgaatctctgaatagaccaataacaggagctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccaggcagagacacagccaaaaaagagaattttagaccaatatccttgatgaacattgatgaaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaacctctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatcatctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaagaagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcactggaacacaacagagccctcagaaataatgccgcatatctacaactatctgatctttgacaaacctgagaaaaacaagcaatggggaaaggattccctatttaataaatggtgctgggaaaattggctagccatatgtagaaagctgaaactggatcccttccttataccttatacaaaaatcaattcaagatggattaaagatttaaacgttagacttaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaactgggcgaatgacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaaatcagtgtggcgattcctcagggatctagaattagaaataccatttgacccagccatcccattactgggtgtatacccaaaggactataaatcatgctgctataaagacacatgcacacgtatgtttattgcggcattattcacaatagcaaagacttggaaccaacccaaatgtccaacaatgatagactggattaagaaaatgtggcaaatatacaccatggagtactatgcagccataaaaaatgatgagttcgtgtcctttatagggacatggatgaaattggaaatcatcattctcagtaaactatcgcaagagcaaaaaaccaaacaccacatattctcactcataggtgggaattgaacaatgagatcacatggacacaggaaggggaatatcacactctagggactgtggtggggtggggggaggggggagggatagcattgggagatatacctaatgctagatgacgagttagtgggtgcagcacaccagcatggcgcatgtatacatatgtaactaacctgcacaatgtgcacatgtaccctaaaacttaaagtataaaaaaaaaagttacatttgaagacagcaattttttaaattaaccactttataaaatgttgtgcaagaattttttgttttgttttacataagcaaaacagaaaatgaaacatctaagaaaaaaagtggctttctaaatgcttaaatgaatactaactaatgtcaatgaatgacacttacactaaaagcaagccatggaaaatataaaattcacacaatagggcctgatcaaatctttggtagttgtcccttatttctcttttcagatataaaaagttaatgctgtagacaatgtagaatctacgaaagaacacaaagacaacaagtacccccaccatccagaaataaaccctatcaacagttaagtatccaaagtctatggcaccaacccatggcccaggatgaattctgggaatcttcagccaaactctcagccatcagaattgtcacttgtcacttcaggcttcattgtaatcaacaccaaatcatatggtccaatactttacagagaaaaggtattgctattttttacaaccacaacagcaagcctggcacttacatgcttcaggttacacaaatgctgaaaatgagggtgagaacacatcataaagtttattggagaaggcagtactgactgatgcacagttcaaaaatctttacaggggcacagggaattgaaatagcagaaattatcaaaaacaatttcttgccctagttttcaagctctgggtcctttaaaaagtgtaataataagctgggtgcagtggcacacactgatagtcccagctactcaagaggctgagggtgagagaattgcctgagcacagaagttcaagtccagactggacaacataccaagaccctgtctccctctctctctctctcttttttttgagatggagttttgctctgttggcaggctggagtgcagtggtccaatcttggctcactgctacctccacctcctgggttcaagcgattcccctgcctcagcctcccaagtagctgggactacaggcatgtgccaccccacccggctaatttctgtatttttagtagagatagggtttcaccatgttggccaggatggtctcgatctcttgaccttgggatccgcccgcctggcctcccaacgcattggaattacaggcatgagccaccgtgcctggccgaccctgtctctttttaaaagtataataataataaatagtagcatgcacttaactaataatagaggtctgttaatatcactatcaccacaacagagttataaagcacttactacatgtcaggcactgcaagtactttgtactctcttttcccctaaaaccttatcacaatcatgagcaaaatactaaaataagcccacttttcaaatgaggatttgggaagaaacatagtacatcccacctctttttttttttttttttttttttttttgagacggagtctcgctctgtggcccaggctggagtgcagtggcgggatctcggctcactgcaagctccgcctcccgggttcacgccattctcctgcctcagcctcccgagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccccatcccacctctttaagggggctgaactgggattaaaacccaggttttcctactctggaagctaagctctaaaattttacactacctggcttcatatctcattctgcatcaagcatgttgtcctctattcttagactactccagaaagaatcatgcctcagggcctttgcacttgctattactcctccctacaacactcttgtctcagttggccactctttctcaagacagccccagtgcttgctcccaaacttccttcaagaatttgctccaatgtcaccttcttggtaaagagcttcctaatggcttactgtaaatcgtaagctcttcctcccacccttgaactacctatcctgctttatctttctccacagcacatatcaacatctctgctggttattaaactagtggcttggctccaaatctacccttccaaacactcttctgcaatgctcaagttaggagtctacaaactgtatttcccaggattattctgcaataggggaaaactgaagaaagtgggaggtcagagtggactagctacttcccatatgtttgctgttcctgtcagtatgtccccagcagaggcccttcgccctggcagcataagttggttccagtctccaactcccgagtcagtctcatcgcatcctaagaggtaccagtgccaccttctcggacatctgagctctctgccacagggatccctcctctgagcctcgagactcaaacaactccaaactctttattttgatcctcccacccaaccatgcaggctgctttctgaagttatttcctttgtgtgacctcagagctctctttctgctttttcagatctccaacaccaattccccataacagagtccctctgttgaaaaacctagtatgatttttgctttcttgactggatcccaaatgatatacttaatatgtaataactttagatttttaaacaaaatttagaaaataatctttccacagtagcattagaacagagggttttgtctgtctcattactgttgaatcctaagcacctggagtagtatctggtccatattaggtgctgaataaacatcagctgaatgaatgtatccctctagttagcagcttaaaactaaccagaagacattgtctaggtttcagcctaaagactatcttaaccccaaaggcttctctgaccctaactaaagtagatcccctctagttctccttcacagaccactgcataagtctaccacggcacattttacaatctgtaaaatgactttctgtatctgtatatttatttatctttcttattcaccataatattaacatcataagaattagaattgtgtctgtcccactacatcttcagtgactagcgcaggctaggcacgcagtaattgcatgatttttcgtggaaataaaggtacactggggcttaacttcacgagaaaataatcatttggacattttattgctcttcccacaagaaaaggtaggagatgggaattagtagtgatctcagtgggatcctgtaccctaaattccttgatgtgacttggaatcccaaatagctgttaagccaaatttgatttggtggtattatgagacattgttatagtcacaaattaaaatacttcacaaacatcgacaccatgaaaaattaaaacctgtgttgaaatcctctatggtttcagcaaatatgtactaaacacatactatgtgccaagtaatgttgaagacggtagatgcagcaaaaaaaaaataaataaataaaccgagtttacgtctccatggagttgatattctagtcagtagagatacacattaaataaactagtaaatatgcaatatgtcacttaacgtgagggagaaaaagcagaataagagtggtaggaaattttcaatggtagaagtagaagtagaattacaattttacatgatgagggaattcctcactgagaaggtaaaatatgcacagaggactaaaggaaatgagagcaggagccatgggccaggcctggaagtgttctaggcacaacaggtaacaccaaacgcaaatgtcctgaggcaggagcaagctatgtgtttgaattacagtaagaagcagagtgggtggggtaagagaaagatgttattaggttagggcaaacataattgcggtttttgccattactttctttattgcaccaacctaatagatcagagagacaatgaggacttgacaacacagagagatagaggccaccataaggactttgtatcttatgaggaagatgggaagccactggaaagttttcatcacaggagtatcatgatctgacacacacacacacacacacacacacacacacacacacacacacacacacatatatataatttttttttggatggagtcttgctctgttgcccaggctagagtgcagtggtgcgatcttggctcactgcaacctcagcctcctcagttccagtgattctcctgccttagcctcccgggtagctgggattacaggcacctgccaccacggctggctaatttttgtatttttagtagagatagggtttcaccacgttggccaggctggtctcaaactcctgacctcgtgatccacccactttggcctgccaaagtgatggaattacaggcatgagccacctcacctggccctgacttagattttaaagagatcactccatctactgaattgagaataaactctatgatggactagagtggaaagaggaacaacagtttggtggttattacagtaattgaagttacagattgtgataggttattcttcccattaagatgtggagtccaattccaccccctgtgtatttgtgttggccttagtggcttgcttgattgaaggaataaggcaggcatggtgctgtgttacttccatggctaggtgagaagaatacttgcagcttctgctttggtcctttggcacagcagctcttagaacataactgcctcactcggagaaagctggagagacccacaaggagaaaaaaggaggctcccagccaacaaccagcacagctttgcagcaaaatgagttggccatcttagaagtggactggctagatcccgttgaaccaccccacctactcttcctgaaacagacacaagccatcccgctgagccctagtcaaattacagattcatatgcaaaataaatgcttattattttttaagccactaagttttggagtgatttgtgacacagcaacagataaccaaaaaaagaattcacgatagctcaaactagccgtaagggaaaagatagttcctaatgcacttatgtggaagatccttcaataatatggttaagaacttggggttttggagccagaaaaacttatatttgaacacagttgtatcacttaacaggtaacccttggcaaattaattagttttcctgaacctcagtcagttacctcatctgcaaatgggaagagtaatggggcctagtttcttgagatattgtgaggttacaaggagataatgtaggtaaaatgctttgccccatgcctgacacttaatgagtactcaaaaaaagtgagctattaataggattgattttttaccattttaaaaatggcaccatatcattcaacattctcaaaaatggaagcttctgtggcacaactcccggatttccactacattaagaggccagatgcaaaaagagttatagtcccaggagaaacaagagccacagttgactagccatcttctatgcatcaacagtgtttattaagatgtcataggattaactgccagactgcctttcagaagcctttcgtgacttataaaccatggtagtcatgggagctaactcaatatcaccaaccctcagcaaaatagctttccaaaattttaacactatcacatctattttggcaaacatattagccaattcagtggagggcaaactattatgacaccaacttaagagattctgcaaattcaaggagaggaaaaagggcatgattttatcaatccatcccaaatcttgctgctgacaattagtgcaaaccccattatataagtctagatgtgagatgtaatatgtaccacagacagtggaaggcacttcaaacagaaggatcaatttaccactttattaacctaagcttgataacagatctctgttagagatactactcacatcccacttccactttattacagagattacgctgaatagagaactgatttttaacaataaaactctttctatggcctttagccagaagcaataaaattctgacctcacagctataacaaaacagagaaacctcctagcatatatctctatattaaacaaccagccttcaagatatatcactggaaggatgttggaaagaaatgctgctttaaaaatatcaatagcccacgatttaggagcaagtacaagagatgtttagaattggtttaataaatatttaaatacatatgccaacatgccattagtttatgaaatatagatttcagggaatattgacttgaggcctgtattacttactgagtattaatatacaatacaatgaatattcatggacaatgaaaactcactattttaatgtaaatatgcatacctgagttcctgagtgatttatcttcctcttgggtggttgttacatggtaataaatgttatactctttgccatacattaatgagtcatttcaggcccaagagctttatgaaaagttggatgttatgttgtaaggcattagaaagtcattataggataacaatcagaaaactcagtttttacaaagaagctaccatttctctgctgatgcataaaccatagctttgctattttaaattataatggtgattaatctgattgcttatttcaatgggacttaatgtatctgggatgtgttcctctgacatttctattcttcttcatagctacataagcttaaggtaatgatgagttcccaaatctctattataacagaaaagtagcaatacagagggaatactatcacagaggaaaaaaatccaaacggaatttcataccctccttcactcttacaatggccttcaccaagagcagtattttctgccacaacatggcctaaaagtgttaatatatatccagcaataatgagatatgagtcaaataatgtcaaaaagcactgagttcaacccaattaaaaagaattcttcactgcaagacttctcaaaggtgttgaatatgctgatattaattgagagtttccaaaaagaataaactatgctgtgtttacccaactctttcttcacggagcatttcataggactagtgttctataagcacaagcataggctgctggagtttaagtaccactttccctaatctcataggtaacttacttgggtttttaaaggatctctaaatcaagaaaggattcctgttctcattttctcccctacataaagccaagttcaggatgaaatctcacaatgatgtatgagaaagggtacactttctagacccagtgtacaacaacaaatacaaatttaattacatcacttaccggtttaaagtccctccagtagcttcccaaactctacacagtaaaacacaaattctgtcaatcaagcttttgaaagtttctttatgacctcctcatcgtttcttccccagtcataggtgtcagtactcaagacttcaatttgggtacttttagctccccacaaacctctccccaaagtaaatgcttcaaaggcagacaagccctggctaatttagctgaatgtggtacttctggcacttagtttgattgtctgcacttggagattctatacctataattccactaccaaaaaaatatttatgccaccaattcctgctgcagtaggggtgggaagactcccatatgtttttttggcttcaggctcagcttacacatcacttcctccaggaaccttgtctgatacaaaaaggttgggcttagtatcattactatgggttctcatagcattcattcctttcccacactttagaatatcccactctccattggaatgacacccttactgatctcctcaaccagaatgtatatttcctgggtgctaaagatggagtctaagcacacatattatgtttgccagagtcttttataccacagtcaaccaataaaatacatataatcttactgtgtatgatactattaccatattagccaattattattgaactaatgcatgcccaccatttatctcaagagtagaaaactctaattcagataataggaatgtttcatgaggccatgctctagtttacacaactgtgaaagttcaacagagggttactggagtcactataaacaccatttaatgtggcaaccttaataatataagcaaggtcagaaattttaaaaaggaagagagggaggcgaagagagggaggcaaggggtgggggagggaagaaaaagcaaagaatgcaagaaaaaaaagaaagttaaagagtagtgttgtttctccctgtaaatgaacttctgtcctggagtgaccaggtgactggaggctgttctcccactagtctctgtttcacatgcatcctgttccatggagtgttagatattgcacagattaagagaatttcaagggaaatcttgacctcaaacaattttgtttgcctcatgtgcttgaaaaggaactcatatgtaagttagaactcaactgcacaagtattttaagaaagaatttttctctcagtcctggaaataactggaaatagtggttagaagtgaaacacaaacagtaattagccttaggggtaaaaatatcccttctacaattttgtatcatttaaaatcaccagcacaaatactttcagagtaagaagcctgagagtgcacgctacagaagagcttatgatgtcctattactgctgtcaccaacagaaattcaaacgcaaagatcacatgaaacacagacctcaagttactacagtgtttgttacaaagcaaatgctcaatgaaactttgaaaagggaagagaggaaagcagaaagggaaggaaagcaagaagaaaaggaaggaaaaatgggaagagaaaaggaaaaaggaagaaaggtaggaaggaagaatgaaaagttgattttggtctttgggaaagttttgacagcaatctttcacaacgaacattttactatgtactctcaaatcacaaagttggtgtacaatggcaacaggcaatactacccagtggaaaatatctgatgcattctatctggaaacgatggagtctctcataggtttcaagagaagaaaaacaattgccataggtaaaacagaagtactcttttctaatcagcagctcataaaattgctgtaagaatgtctaagcaataatgaatagaaagtttctctcacacaggactgggaacttacaggacttaatatatgttagtcatgtttcattactcttatagaaaagttagacatgtagggtaaattggactgtcttttgtcaaattcccaaagcaaatatggaagggtttcagtgcatcattcaattccacagtggaccatgctcaaatagaaacgaggatgtagaaacaatgaataaatgcatcccagtcgacaaagtgtcaacacatcctactctgctgccctggtgtgtgagtctgaaaatagtgaagggcattgaagttatgtagactctactgcagaaccaagataggctgaatgatagatcgcaacaggtggatatctgatacatcaggccatgcagaattcctagtggtcactcgcattctaactctctctcagctccaaggggctctctctggaggttggatctcatccacaaggttttggccaggatccagaaacatgtaataggaaaactggcaaaggtcccaacccagcccattaatgatctgcaaatggtaccctttagatcaaatactcaagccacaggacttggaggtgcagcctcacgtttgtcttccagaaacaattatttcaccatcgaggttcacttgtgctgcttgctagaaatcattctcctctccccttggctccagcaccctcagtcataatttcaaacacctacttggaattgcatccctagactcaaatttacacattctcatctccctataatgcacccatttccagctcactgccatcaatcagcaagactgccagacactactatcccactgcaccgatgtcaaagccacaccacctctctatggacagacacatgctgagcagaggagtacctttctcaaatctgcaactctgcttcaatatgaccctcacaaacaccctcaaccctcagtaggtttttctttttctctcttctcctttacagtatttgtagccaaacacattgtctgctgtactgggataatctgcagagaaacaactgactaacctttggaatgcttttaaaatctgtagaactaagatacacacatgctacccaaagatttcatcctcactaaggaatcaacagtaatctgagaaatgttctgtttggaatgttgagtttttaagtccactaacatggcttctgaaatggtaaaataaaatggcatctttactttcaacgaatgctctggtctggaataagcactgtataatcatctgagattataattacatggtcattcaattacagtcacagagagcccctgagttgtaaaaatttatgaaaaaacaaaagaacaaaacaacttaccttgtcaataatatagcggtagaatgtgcttaactcaacatctgggttttgatggtgggaagccacttattaattatacaattaggtatcacaattgtacaagtatacaattagtaggtattatttcctgaatacccactgtgttcaatcagcgtgccccatataagggaggcacacattgtcccctgttttaattgcttactttgctggggacttcagtaacttcaccaagtcacagggggaaatcacaatttatagaaaatgtatatggaaaaaggcttcctaatctttgcaaaaacaaagaatcttttgttatatgtaattagtttttaaataactcatggtaaattctccacttctatcataatctacatcacctaataaatgtgatttgcaagtgagaaatatttattgtgcttttccactccagtggcggcagggtgggatatatgcttgtttcacttttctttttttcctgccctccttgatgttcagttcactgtgaaggtgttgttgacatctttgccattttttgccaaaatgactgctcaaattaaggtaacttgggaagttactgcctgtaaaacaaatggggcgtcactgaaatggctattccttgattgtatttcatttgaaatttaacaaagtcagagagatgggtcccacaagcatacctctagtaaaagctccagctcttacttgcaacgtatgttatgcagcaattatgctaccaagctgcccagaattctttatctgcatgcaaattagtttatatgtgctacagctgccattatgacagtattaaagaaagaatttggtaatgaaactatcctctttatggaaatgcagttcaattaccttaataacacattggacatacctgcaattgcttataaagtgaaaagcccaattctctcctcacatgcccagaccactgtatttaacccaccttctcatcactttaaatacaagaacaaccaagagggggatttctaggctaccttttacaggcctgactctttcagtgctatgatgggagcattccctcaactgacattgtgggtaacttggtgattaaacattcctacaatcctctaatagttaaaaaattaaacggtcatccaacccacagctgttagcgcccagttttgccatcaatcattaacagtaactcctgggaccttcaaaggccaccagcaggcaggagtgagaaaggaaaaaagaatattaagtccttaattccaggcctgaaagatacatataaagcaaagaaagcaggctttaaaaaactctagaatggttatgatattttaggaaggctaagattcacgtatcttctcttcttccattggtgattgtcttgacttctcaaacagccaacctaaatcactgcttttaggctgagattgcagaggatgagcaacagctcctttgtcacaccagtggctccttttaggaagcaaagacccagcccttaacactggcatttccacagcttgccgaacttgggatgctaccataagagcactgagtctcacacctaacttacattgttcagagttaattatatttcagggctgggtacggtggctcatgcctataatcccagcactttgggaggctgaggcaggtggatcacttgaggttaggagttggagaccaacctggccaatatggtgaaaccccatctctactgaaaatataaaacttagccaggagttggccgggcgtggtggctcacacctgtaatcccagcactttgggaggccaaggcaggtggatcatgaggtcaggagatcgagaccatcctggttaacatggtgaaaccccgtctctactaaaaatacaaaacattaactaggtgtggtggcagacgcctgtagtcccagctactagggaggctgaggcaagagaacagtgtgaacccggggggcagagcttgcagtgagccgagattgggccactgtactccagcctgggcaacagagcgagactctgtctcaaaaaatgtatataaaaataaaaaataaaaacaaaaataaattagccaggagtggtggtgcatgcctgcaatcccaactactcaggaggctgaggtaggagaattgcttgaacccaggaggcagaggttgcgagatcatgccactgcactccagcctgggcaatagagcaagactccatctcaggaaaaaaaaaaaaaagttaattatatttaagagagatcataagaagtaccaattggcaattttttaaaaagtggggtggggagtactgatcttcacataaaacaaaggcatttttacagactgctttttttcagttgggtgaaagactacaaagattttaagagtatcataagttaacaaaaaatggctttttaatttctccttgctccactgctatcatttacatcaagaaaaaaactgaaacaccttgaaaaaggtgttctgaaatttagactgaaaactaacagaagcactttatttttacctcgcttttctttcactccacgtcaactgtcacaaattgatataacattgcaaaattcatccaatattgcaaaatttatctaagcgtttctcaaaactaagattttcaacacagcgaaattgctgtcaaacatggtgctactttacatagccgaagtccttcattcattcatggaagagattcaatagatacaccatggcaggacagggactagggcctaaagtcaccatggatatataaggagatgtagtgtctgtccccatggagtggaaactccaatgaacttatacctctctttagtaagataaaaggcgggtcacagaaccatctgcatctcaatttctgaacctgtaatgtgaagaaaatatcacctatcacaaagggctgttgtgatcatttcaatttgataatctataagagttaagcactttgcaggatgtgtagcagagaacaaatgctcagcaaatgtcaactcccaatatttcccctcttctcaaggtaaaaactggcccctgtaccaaaacattattttaccattcaaaatactatggagtcaggcgtagtggctcacacctggaatcctaacactttgggaggccaagacaggaggattgcttgagcccagaagtttgagaccagcctggacaatagagtgagaacttgtccctacaaaaaaatttaaaaattagccaagcattgtggcacacatctctagtctcagctactcagaagctgaggtgagagaatcactggaaccctgaaagcagaggttacagtgagctgagactgcaccactgcactccagcctgggcaacagatggagaccctgtttcaaaaccaaccaaccaaccaacaaaaaacaaaaacaaaatattgtcattaagtaatgcctaattggtaaatattctttttttaaaataaaaaaaaaaaggcttggactttctgctcccaggttaaaagaaagagattttgagtagatacttttcacattttggtaaaatacacttagcataaaagtcatcatttgagcaattttaaattgtataattcagtgacagtacattcataatgttgtccaaccatcatcactatctagttctggaacatttcatcaccacaaacagaaactccatacccattaagcattaattccctgttctcctctcccccaagttcctggcaactactatgaatttgcttattctggatatttcatacaaatggaatgatacaatatgtacccatttgtgcctgtcttcctgcagtgtgatgtttcttatagtgaaacgttttcaaggcatgtaatgtggcatgtatcggtacttaattccttttcatggctgagcagttgtattctctcacatggatataccacgctttgtttatctattcatcagttgatggacatttaagttgtttccaacttttggctactgtgaattatgtgcagttatgaacattcatgtatgagtttctatttaaaaatcttttcaattcttatgagtacatacctaggagtgaaatagattttacctatgtatacacacacatagataatatatggatacagacataacacacataaaaatgtatatacacatataatatatacacatatatacataaatataatatacacacagtagctcatttctgcagtagtaagcctttgctatacttgcctggttaaggcctttccctctctttctccatcattagctgatcttgaccctctcccaccttcacatttggaatgtcttaaatgactttaagtcctctccatatcccacctgtttacatattacccatatatgtgtgagagtgcctagctagggattcagtaggtatttgttggaaaaaaaatgcatgaatgaatgaatgaagcaataccttgcatatagcacaaatacagcaagcacctgtagcaagatcaacgccataatcatatccaaggttaaaatagagaaggtgatccctagtgttcagagtgctactttgaatgtcactttctggatacctgtcattaatgtcatccatgtcactgaattaggcgagtgctaattcatccatgtcactgaattaggcgagtctttcactccttttctccatcacaaactcctccagaaccatatagcacagtggctaaaaatataggtttggagaggctgaggtaggtgtattgcttgagcccaggagttctagactagcctgggcaatgtaatgagaccccgtctctacaaaaaataccaaaattacccgggtgtggtggtgtgtgcctgtagttccagctgctactggagagactgaggtgggaggattgcttcagcccaggaggcagaggttgcaatgagccaagattgcacacgactccagcctgggcaacacagcaagacacatacgtatgtgtgtgtggtgtgtgtgtgtgtgtgtgtgtgtgtgtgtgtgtgtgtatatatatatacatatatatatacgtgtatatatatacacatatacacgtgtatatatatacacacgtatatatatatgcacatatatatacacgtatatatatatatatacacacatatatatacacgtatatatatatatacacacatatatatacacgtatatatatatatatacacacacacacacacatatatatatatatggagagagagaaagaggaggggtggggtttggagaaaaacagcccagtgttggaatccgcattggctctgttattattcgtagttcccataaatttctatttgcatctctgaaaaataaggacaataatccccatgctttgaagttgctatgagaattaaatgacataagtcatgtgtaatgcttaacaaagtgcctggcccacagattaatggtactgcttaccattaattaagtaggttcctagcataagcaaaatctctttttttacattaaattctctcaggacacaaaaaaaaaatctgaaaaaaatcaaccccaaatgctccaatccagacctacagctttatatcaatatactaatggatctcaaattgtatctcaaatttatagctagggttgtcatctgagcaacagacttgcctatcatccaactgcctacatgaaatctccacttagacccgtaagagacagcttagaattaatacagtgcatgcctaatacattatcgtcaggggaactcgggtgaagggtacacaggaactctactatgcttgcaactttatatgagtcaaactatttcaaaatttaaagttataatatttatttaaaataatagttataacacacaattattatttacagtataatacttatttctagtaataataagattaacattctcaaactgaactactataggtttgctctctggctccaattccctatccatctttgtaaatgaaccactgtccaaacaattgctcagatgaagcacttagggcatcaccctcaagtggaataaaatagcattaagaacatacacgccttggggccagactgctgggtttgagtcatggctcttccagtttccagctaagtgacctcaggccagttccctgactttccaatatttcagtttccccatccataaaatgagaataaatagaacctatagcacacagttattatacagattaaaagagtgagttaatacactaaagtgcttcaaatggtccacttctcattgtaagttttcaataaagaattagccatcactattattattttcccttagccctgcacttacatcccacatgtattctaaacctgaccacttctcactctctcagctgccaacaactctagtataaccccaccaccatcatcaattcctataaatccgtacagttccaatcatatctctgttcccagccttctccttctaggattcattttctgtaatagttagagaaaactttctaaatcctaaaccaaatcatcttatcttttactccaatggtttctattcaacgttccaatcatttcctattgggagcaatttttttgaaaaactcttaataatggcctaaaaaattctctatgatctcactcctgctttcttctctgacctcatctgcttttgttctcttcactaagacacaatggctttgagcatgccaaagcttttgcacttgctgtttgtggcatggactgcgacttaatctccaacattcattctcccgtgctttcgaacactcaatttgtcagggccacatgatgccctggaatacagactacatatgtggcctaccggcagctagacataaccaaacaattacattctatcaatgggatctaagcagaagtatgtgtaactttcaggaaaagaccttaaatagagaaggcacatctctcttttgctctttctgggtcagactggctacagtgcaaaaacagcagcccaagcttggagcgtgtgtttggaaaaatgcaattaacaagagagaaggagccaaaatctgtggagggaaaggcaaaactacagaaggaatctgggtccaggtgatcatcaagctgcatcatcagctctaggttacttaccttggagaagaagaaacatacaatgcactcctatcctgtaagctgctttaatttatgatcattccccttttctttgcagagcaattttccccatggatccatgtgtggctgcctccttctcaccggtcaagtctcccctcaaatggcacaacgttaggggtgtcgctggtttagcaggaccgtctctctctcctgatctataccacgtgactctatgctttcttgtttgcagcatgtgatagcacaggaattctttatctactttgtaaatgtctgcctccttccacctaaagataaacttttggggggcatccactgtagccccgcacacttagaacagctcctggattgcaaaaagaatgcaatccctattttttgactggcttacttatggtatgttgaatgacctggctttgtgtttcttccaaatcctgggtggttttccttctcatctcaaattagtagatttaactcagtccaacatttacggagcacttattgggtggagacactgtggtagacactggagagataaagaccaaaggaggtgtggtcactgaccccaggggcttcatagtaacactgcaatctgctcttctcatcacagaatcaaatactgaaggaatagataagctgacagtaacttttgcgttgtgtttacttaggaagaaactcagactgtacccgtaattgtcatttttggatccatttcttaaacacactgcaatcattactttagtgttgtgactatcacaaaatattgacaacttccaaaatacagtttcaaaaggtcattaaatacgtaattattgaaaaattccatcggtgtaccatgatcgcctcaaaatcactttctagaattcaaagactttcactaccctctgaggaaagtgacatgtagaattctaccaaaaccatgtagaaagctatatacagagttcttttaacaagaccaaatattcccccaatgaggcagcttctaaaagatctcctctatcaaaacattctctgagcattagaatccatgtggttaagaccatttcttggtggaggctttaaaaattcaacctgcaaagtctcatgaaatcatcccaaatattacatccatccaatccaaaattctccactactaggtaagatcattcatgaaaccttatatggcttatgtaaattctagactcagaatgttttataaaaagcacaagcactagcttagaggtggattctctggccatactcaagactggagatgactgaagcctgacagcttgattgcaagcttgtgagacagagaactacccagaactacctaagccagattatggattcctgttcctggattcctgacccttagaaacctggtgagagaataaatgtttgttgtatgtttgtgtgtgtgtgtttctacagcatgatcactggcagtcctatttccaaattatacacataccataagtgcagggctcatgcctgtaatcccagcactttaggaggccaaggtggtaggatcatttgagtccaggaatttgggaccagcctgggcaagatggcaaaacctcatctctacaaaaataaataaataaatgaaaatcagccaggcgtagtggtgcacaccggtagtcccagatactcaggaggccgaggtggaggattatctgagcccaggagttcaaggctgcagtgagctgtgaatatactgctgcactccagcctcggtgagagagtgagaccctgtctctaaaaaagaaaaaaagagtgtgggatttggaaagagagagagatcagagtttgaaactagcccaagccatgttacttgggcaagtgtctgcataaccattccatgccacagttcgctgagagctaacatgacaaacaaacaagatcaggaagtgagaccacagtgcctggcatacacatacagtaagcactcaattcacattgactgtgatgtcagtgagaacactgacgatgatggcaagagagcaccaagatttgaacccaggtctggctgcctccaaattcaatcccatttcactatttcttgttcagttttttcattcttggccaccaatccagggcatcagtaggaggtttcagctctgatttctaaggcatggatgctgccgagcctctacggggtgagtttgttcaaccccatcaccatggcaggtaatttgtgcaacagaaaggatagagattgaatggaggggaagtgccaactctccatgtgggggacaaggcaccatatggcccagcaattaggaaggaagaagactgccaaggacaaaaataactctggcagaatccaacacggctggtagaagtcagcccaggtcagctccttcttggtggtgttgttcttgttccccaagggactctactgacactccttaccatgaatttgaaaaagatatgaaagaggaaaaggaagtctgatgatagtggagagttctaataccagctcattaaaacaattttcctttttcctaaaagcctggtgcaggaatagctcttcaaagggaagatgtgcttcaagagattattgttaactttgaagaagcttaacaacctcactctccttgtctctaaaagaaggcaggtgaactaaatgagatgccttgtctcttgcagctctgaaataagctgttgactccagtcaataagccagagatagcaacaggaagaggaagaaggaagctgtatagattcaaccctacccattttctacgagtaaagtttgtgttcaagaaaaagaacagggaacaaggactcagtgaatttctgtaagaattcaggcatgcttcacaccaggaaaacaatgaacaccgtactctttcaaatctaaaaagcaatccaaatgttcagtttctttctcttctaatggaatgaaactatcaatggcattcaaataccatcactcattcagctgaaagctgttttatgcatgtaactacaaggggatgattcaaaggaaaaaatgtaaggttttatttggcaaaatgaaaattaatatttcttaaaatagagatcagttaggtaacctctatcttaattatgacacttcagtattttttcttgacagcttaaagtcaaaatcacccttcattgctgtttctttggttaaacagcagctgaggaagctggcttgagtttaaggaccatgttgaattttttaaaatatagagtaagacactagaataaacacccacttggtgaggtgctcacaccatgaggggcacatgggaactgaaaacaaatggagaaatccaactcatgactaaactcctgttcactttgggacctttacacaccatatgcaaaggcagctggcatggactgtgttatttacacttatacgttttcccctgaactttaagttagtacacactgttgatttggtgtctgttacatacatatatactgatgtttccctgtatatttttgttgtttttctaatcttatcacccctactaagctacaagttctgtgaagcctagattcacctttgtataataactcctagcatactatagattcctagcttctagaacttcccatatcggaaggtctcaggaaacctgcatgggataatatgaatgaaaataaaaagtgacctggatacatacatatctctctccctgaaatattgctagagcatacccttcctgggtatttgtacaaaaaagataatgagcattctggctggctcctttgcaacagttataaaggcaaaaggaataaaaaaaggattccagggtcttttcaaaggagctaatacggtagggtgagatttatattagaaatgcactgtttcagtctatctagtcactattacccattttctggccaccagttcccagctcctgaggtgcatgtgaccctgagcaagctaatcagcatgatccattctctagtcaaagtgttcagggctggccatatgatcctggttaatctaaccagattcaatcttgggacattggttgtaaccattgagaaaaaggagaaaaagaaattcacttttcatgaaggatgctaagcttcaaggatgggactctaacactgctaggaacaatcctcttcccaccagagataagactgagaatggcaccaatacagcagagggcagaagacagatacaaggacagattgctaacatggtttgggtacccagagccagccatgcccgtaggtagtttatctttggacgttttcattaggtaagcacataaattctcttttctgtttgagtatgaattcttctggctatgacaatggaatgaattttaagtgaaatagaagtgttacgggggattgcacaggctcataaaactcaagtcctttacaatatatcccaacctacgctgtctaacctcctctgccatcatccctcatccattctgtgaatttaagttctaaatgcactccactatacactgtccgtgaatagatcaaacacatttattccaacatgcctttgctcaagctattacctctccctatgagatctttccttctttctctgcccaggaaactcctattgatcctacaaagcccgtttttctgtggaagccataccattcataagcaggagcaggcactcccttctccatgttccctttcactcctttctctgtgttcccttttgcattttccccataatttatggcaccttgtagcatttgccacattggctcactgttatttattcatgtgtttctccccaaactgtaacttattcatctttatctcctcatagtttaatgttcaataagtgagaaggaggaaagaatggcagtgggggaatgttatggtcatgcagggcaaagaaggatagactctgaacaagagtcttcagaacttgggtataccttgcaataaaaacaataatcaggaaatcattgctggattaaaaatgacctcccaacttttcgccttccactgaaaaaaatcactagattttttaagtgaatgcaaaggaaacaattgttatttaatagtcaaattaggatctcatgctgttccccaaccccctgaaaattacacatttaaagagaaagattatgaagataattatcttttaaatgtatcaaacacggtggctcacacctgtaatcccaacactttgagaggccaaggcggtcggatcacctgaggataggagttcaagaccagcctggccaacatggtgaaacctcgtctctactaaaaaataaaaaattaataaaaaaataaaaatcagccagtgtggtggtgggtgcctgtaatcccagctactttgaaggctgaggcaggagaatcgcttgaacccaggaggcagaggttgcagtgagctgagatcacaccaatgcactccagcctgggcaacaagagcgaagctctagctcaacaaaaacaaagacataaataaaataaatgtaaacagttatgtttacaacaccctctgccttttccactaacttataggttggagtataaggataaaaccagaagacagcattattgggaaccagaaaaacaatgacctcaagacttgtaaattctccatataaacaacaaaataccacagctaagaataatgctttaagtggcatggactcaggggatattctctggccagattaaaagatacacaccatccttccatgtggtgataaaaaacactgatctctatctacctccttctctgtcatccaaaaacatttttctcatgtgttcagcattttctaaaacaagtaactatgcagaaatcaattccctacagttaaatttataccaagttaggctggcattgaactgcaatataccaaagctcttagaaatctggcaaatacaatatgaaggatatcaaaagaagcctgtaattgagctgaaaaattaattatagccctaatgtgattctcttcaatcaggaaggtccactagatgccatgctctcatctaaccctcagagcaacattaatatccacaccagacggacaggaagggcagcagtcagacccagagcagactcgtttctctgttcgatcctcaacatttttcttttattaactaagacaaacataccaactatagtcaagcagtcatacaaaccaactaccaacaaacagacacacataccaactgcctactgtcaaccagaaacacatactaacaccggcaaacagaaacacataccaactaccgtcaaccacaaacatgtactaactaccatcaaacagacacatataccaactaccatcaaccagaaacatgtaccaactaccatcaaacagacacacataccaactaccatcaaccagaaccacataccaactaccatcaaacagacacacgtagcaactaccatcaaacagaaacacataccaactaccgtcaaacagacacatgtaccaactaccgtcaaacaggcacacatatcaagtaccatcaaacaggcacatgtacaaactaccatcaactggaaacacataccaactactgtcaaccagaaacatgcaccaagtaccaacaaacagacatacataccaactaccatcaaacagaaacaaataccagctactgtcaaccagaaacatgtaccaactacatcaaacaaacacacataccaactactgtcaaacagacacataccaactaccatcaaaaagacacaccaactactgtcaaccagaaacacatatcagctactgtcaaagagaaaacctcttctgcacaatattgccaagcaaccatctgaaatggataccgtgttctctgggaccaagaacaaacaaaaaagatgcctgtgtccttttaacctgtatcctcatttgtgatcatggccaaagcagaagtgctcaatgaggagggtgcaaggaaatatacttggatcaaaagcctggccaggctttccacactattcctagacacaaagggagctggtttcctgggcactctagcagactgtggcaactatttagcatatgaagagaggcctgtgcctttacccactttctggaaacaaaagcagtctgtcgtcaatataaatacagtttacataccaatgctttctaattaacctttcaccacagtagttttcaccacaagtgcattttccttcttagcctcaggaacctgggagagcactaaccctaggcttctcagtccttgctaatgataggtttccaggggctttaaacaaagtttggatttcaggatcagctctgccacttactacctgaactcaggcaagtaaggtaacctctctcacttcccctacactcacttccacagcaaaggcttaagagctttctcataagatcaatgggaatattaaacaacatatggaaagtgcttaacatcaagatgggctcaaagggaaagtcacaaaccacatacaacagcaacttatgctataacaacttatgctatatgttatgttcagtaacttctaagctaaaagaaatattcgagatcagtaatcacaaccaataggagagagacttctcagtttatacatgccttcctggactactctatctaaaattacatcaaacccctttattctctatccccctcaccctgattcattattttacataacagcatatatcacttcctggcattttatatttattttgggtgtttttttctatattcatgctccataatgtaagcttggttgaattcactactatattcccagtgcctaaaaaagtgcctggcaaacagagaccctcaataaatacctgcaggatggtagaatgaatatacattttaaaaatatagggggctatcaatttttacatttgttttgagagtgggttgtattttattaaaaggatttttgatactgcaggttgctttacatctaaaatggacttcttatctatttattcaaaaactatctattggacagagcatttcacaaagctgtttgccaggtgctaagaaagaggtaatgattcatcagagtatgcccttaaagaggttttagttcatacacactgggttgcatcctcaatgcacaatcattcttccttcactggtaagtgcctctctcccttcttccacatggtgactgcaaatgcagccatgttggtaaaatataataaccagtctgctgtgagagaggaaggaagcagatgtgctgggaagagcagccaggctgagagagggattcagggctccccgtggtgcagcaagccccagggcccaactgttactaaatctggatggtgtatgtatcaaaaacaatttttaaaaaataatcaggcaagacataaaaaagtttgaaaagatatattctttccaagggaaatctatcctaaagaaaaaaactgaaatctgaacatatattaaaacactgatcacacagaaatataaactaccatcagagaacactataaacatctctacgcaaataaaccagaaaatctagaagaaatggacaaattcctggacacaaacaccctcccaaaactaaaccaggaagaagtcgaatccctgaaaagaccaataacaagttctgaaattgaggcaataattaataacctactaaccaaaaaaagcccaggacaagacagattcacagccaaattctaacagaggtacaaagaagagctgataccattgcttctgaaacgattccacacaatagaaaaagagggactcctccctaactcattttatgaggccagcatcatcctgataccaaaacctggcagagacaaaacaaaaaaagaaaatttcaggtgaatatccctgatgaacattgatgcgaaatcctcaataaaatactggcaaaccgaatccagcagcacatcaaaaagcttatccaccactatcaagtcagcttcatccctgggatgcaagtctggttcaacgtacgcaaatcaataaacgtaatctatcacataaacagaaccagtgacaaaaaccacatgattatctcaacagctgcagaaaagacctttgataaaattctacaccccttcatactaaaaattctcaaaaaactaggtactgatggaatgtatctcaaaataataagagctatttatgacaaacccacaacaaatatcatgttgaatgggcaaaaactggaagcattccctttgaaaatgggaacaagacagggatgctctctctcaccactcctattcaacatagtgttggaagttctggccagggcaatcaggcaggagaaagaaataaagggtattcaattaggaaaagaagaagtcaaattgtccctgtctgcagattacatgattgtatatttagaaaaccccatcctctcagcccaaaatctccttaagctgataagcaacttcagcaaagtctcaggatagaaaatcaatgtgcaaaaatcacaagcattcctatacaccaataatagacaaagagagccaaataatgagtgaactcccattcacaattgctactaagagaataaaatacctaggaatacaacttacaagggatgtgaaggaactcttcaaggagaattacaagccactgctcaaggaaataagtcaggacacaaacaaatggaaaaacattccatgctcatggataggaagagtcaatatcgtgaaaatggccatacttttcaaagtaagttttagattcaatgctatccccatcaagctaccattgactttcttcacagaattagaaaaaactactttaaatttcatatggaacccaaaaagtgcaatcctaagcaaaaagaacaaagctggaggcatgacactacctgacttcaaactatactacaaggctatagtaaccaaaacagcatggtactggtaccaaaagatacataaaccaatggaacagaacagaggcctcagaaataacaccacacatctacaaccatatgaccttcgacaaacctgacaaaaacacacaatggggaaaggactccctatttaataaatggtgctgggaaaactggctagccatatgcagaaactgaaactggaccccttcctcacacgttataaaaaaattaactcgagatggagtaaagacttaaacataagacctaaaaccataaaaccatagaagaaaacctaggcaatatcattcaggacataagcatgggcaaagacttcatgactaaaacaccaaaagcaatggcaacaaaagccaaaattgacaaatgggatctaattaaactaaagagcttctgctcagcaaaagaaactaccatcagagtgaacaggcaccctacagaatgggagaacatgtttgcaatctatccatctgccaaagggctaatatccagaatctacaaggaacttaaacaaatttataagaaaaaaaaaacaaacaaccccatcaaaaagtaggcaaaggatatgaacagacacttctcaaaagaagacatttatgtggccaagaaacatgaaaaaaagctcatcatcactggacattagagaaatgcaaagcacacacaatgagataccatctcacgccagttagaatggcgatcattaaaaagtcaggaaacagcagatgttggagaggatgtagacaaacaggaacatttttacactgttggtgggagtctaaattagttcaaccattgtggaagacagtgtggcaattcctcaaagatctagagccagaaataccacttgacccagcaatgttattactgggtatatacccaaaggattataaatcattctgctacaaagacacaggctcacgtatatttattgcagcactattcacaatagcaaagacttgggaccaaaccaaatgcccatcaatgatagactggataaagaaaatgtggcacatatataccatggaatactatgcagccatagaaaaggatgagttcatgtcctttgcagacacatggatgaagctggaaaccatcattctcagcaaactaacacagaaacagaaaaccaaacaccacatattctcactcataagtgggagttgaacaatgagaatacatggacacagagagaggaacatcacacactggggcctgtcagggatgggggggggtacaagagggatagcatttggagaaatacctaatgtagatgatgggttgatgggtgcagcaaaccaccatggcacgtgtatacctatgtaacaaatctgcacattctgcacatgtatcccagaacttacaagtataataataataaaacacaggaagatgtttatcacagctatttaaaaaggaaaagccaatcattttagacaaaataatgaaagaacacctttctattctcatatgacaagatactcatatgacatatgagtatatatggggaaagggagaggtgtagtagacatagaagcagatatataaagtagatatatccagatattcaccatgattattactggattataaaattaatgcatatttttcttttattcttggtgccttttatatttttatattttacaaattataataaatgatgactactttattttaaaatgctgtattttaccataaaatactacccaatgacttctgcaaagttcttctgtttgtaaacaactaaacagcaaatgcttccaagaccattaggaacatacctgtagttgtgctagtcaacgtatcactcaatgcagcagggataatgcacactgtggggaactgggggatctcagaaagaggagattgcaaagaacttttataggatttgtgcatgtgttgggtaattttatgtgatttgggggagggttcaaagtagtagggctttgttctagactagatgctgttaagacatggaggtaattccatgattgtgtttcctaataaatcttacctagcatgcagaaagaaggaagcaatgctacaactctaatatttaaagaagcagcagtcactcataccagccagaatgggaggatgtgtggtcttttttgtggtttggacaattttcatgttttgtctgtgttaaggcatgattaccaggggtctcgtttttgttctgatccatcaccaagccacgagcaaccccaatgcctaactgatagcaccgggccagttcccgaatagcaaagaatatataagctgtcagaaatattcagaggcaggtagtatgattagggttatttctgaaaacaaacataatgcaaacctgatggggttattttgtagattaagtaatacatgtgagtgtgatttataaatataaacagccacatgcatgttaccatttgctaatatcttcaccatcactgtcatttatatcaatctcatctagtgcaggaggatctatatctttggaaaggggcgggctgcaacggaaacttgtacattagtttcagtttaccaaaatggttagagatgacggaaattaagacctaaatcttagaaatggacacatatgaaaacttcagacacaactcttaaaatacgcatcccctcataatgcgtcacttctgacaaacccatgagaaagcaaaaaatttaacacctatcccaaaatagagtaacttaaaagaaacttgagaaatggaaaatgggggcaaaggtgaagtggcataatgtcagccacttacttttgatggttcagccaaagagagagagagagagatggcataccagtaacatgtggtgtatatatgatattaaaaaggtaacattttaaaaatgtatatacatggaactcctgaggacttcttcctgtattctcatgggtcatttctcactttggagactacttccttaaaagacctaattacaagaggtcagaatagtggaattgtacataagatgtgtgtcaaaggccaggaagtacccatagtgaagtaaaacttccttactttcagacaggcctttattgtgatgaaattataaattcttagatgactcatattctagccatctattcattcttaagcatctacagagttcctaagaaggaccaagcttgatctaaggtgtcagaggtccatgaagacttctcgagaggcctccctcatgagcaatctctacaggcaggatgatgcaccatttattttataggaattccatctagtagacacccttcccctcaaaaaaatgtgatgatcccatcaaaagcttgcaggcacttagccatggcgagaaaattaaacagcctgtatgtagtaaacgggtcacagaaagggtaggttatgcagaataaaaaataagaccaaactcaggggaaccaggtcctctgaacttttatttttaattagtacatgggcataatggggtatgatctcacacacacacacacacacgcacacacacacacacacacactctcaaactacaaaaataaatctccctctgtcccaaccctagccttccagtccctccccagaaacaaccaatgttttctatgcacacgcacaattgcatataaacatacatttaaaatcataaatggccactaactatagaccctgttaaatactttgctttgtctcgttgaacaatattcactccttcatttacttgtcattcagcaattattctaggaaccactaaaaaagcagtcaaaacagacaaaactcttgcccccatggaggtggtatctcagtgggccattccatacagcatataaacaatacgtcattatttcgataactgtattttcactctattgtaagtacatgctacaatgtacagtcctttatggatcaacattcagtttgctttctactttgcacattcttttttataaatattgggcttgcagcaccctcttcttttataagcaaatattttggccaaaccctgaacaattgtttaaaacacgttcatctatgtcaaggttgtattttgaaaatgcctcattcaatgacttagttttcacttatcaacatctataaaaccacatcagagaagatattcattctagaattgtttaactaagttaagattccagttgattatttgcaacagtttagcaaattaccttacagtttttaacagcctatgaagaaagtaaatgtcatagtcaatccattttttttccttgcaactgttaggtgtggtgttaattctcccagctggttttcagacagctttaaaattaactttgaagtttctctaacccttaaaaaaaagtcaatgattgctttgccaagaaaaacagagcccttactgaacaagtcagaattcactaaggtcttctaatttcaaatgtagaccttctgggcactgtgtatgtgtatagacgtgtatatatgtatgcatttgtgtctatgcatacatgtgaggatgcatgtacatgtatgtaagctaacattcatagaaggtctatgatgcactgcagctgaaggagtaatgctgaaccactgttacatcaatccatcttacaaaataaatacataaccaatacaagagtccatgctgacttataaaacaataaccccaagatttcttgagcacctaaaatgtgtgccaggctctgtgctgttttaagcgcatctcttatgcaaaataactcaatgtaaggataggaaagctgactcttacagtggcttagatactttgccacgttaattcaacccctaagcgatagagctgaatgtcagcgtagacagcctctgctttaaaatctctataaagggtatgacactattgttaacttctaaatacatctgataatatctgcttataaattatgagatggcattttatatctattaccagagtataacatatcacgtaggatttatacaggttaccttatgatttttataaatgtgggatccattattcaacccacatctacctactccacatctgggtattcttttttgtcacctcaaggtaccccagaatgaaaccatggagaagttgtactgcccactttctgcaaagaagcagggttaaaagcaggagctctggagggctactgcctagattcaaatccgagcacagtcacatggtagctgtgtgcactggacaaatcccacttctgtttatctgtttagtgggaatgatattcttggtggctgagtgtattgaagaggaatatatatatgaagagctgatagcagtgtttgccctatgtttaggtactccatacagcttgcaactatggttatttgcccatattcactccataacagaattacaatcaggtatgttctatcccagactcagggcagagcctggagttcaaacataccacatgttgagaaaaaaggtcaactatgaagttcattgggagcttagaacaatgaagaaaagttaagaacaatgttcaaatgaggagtaaatgaagtaattgaggaactccaaaactaccatcccagagctcctcaagcaaaggtctccaataacctcctgcaaccctgcggcaataaccagcaataaccagctctgcagactggaacccattcagtctgatgtgaatacgctttgctctggaggaagaagctctgctcatggcagacaggcctgattgccagaagttacatttcctgtgagtgagcagggaagccacagaaactagagccatggggtattgggggcatcccaggtgaaatgaggctctcaccacctcagaggagccttccgcccacagatgaagcatcccaatgagggacaagaggggcagttggcacacagctcgcaagaaggcctaggcaccctaccatcccctctccctgcactggggaccaccagaggctcagggccaggggagaaaagtggctctacaataaggctctgcacaaaagggcctcccttttcaactcctctccatttgctccagctgagcccagctttatgcaaacaacactctttttttttttttttttttttttttttttgagacggagtctctccctctcgcccaggctggagtgcagtggcgcgatctcagctcactgcaacctctgcctcccaggttcaagctattctcctgcctcagcctccctagcagctgggacggcaggcatgcgccaccacgccgggctaattttcgtattttgaatagagagggggtttcatcatgttggccaggctagtctcgaactcatgacctcaagtaatccacccaactcggtctcccaaagtactgggattacaggtgtaagccaccgctcccggctgcaaacaacactcttaagctcaaaatgcaggctactggaggggtggggtgagccaacagttcattaagtggcagcaggccagggaagcggggtcggcgggaacgggaggcagcaagggggaagggaacctggctctcaacccactggagccaaagtaaactgtacttcaagggaccctggccctaggcggaacgagcctgcggctgatgggccgcccgcgtctccttgcacctgccctggcgccgcagccaaggcggcccctgctcgggccctgcgctccggggcgcgggccgagatgctcgcccaagaaacatggctggctggagcctccgggcgcgggagggacgcgaccgccagcctggggaggcgggaagggggaacttgaacgcccgggcgggcggcaagtgcagcgcgttccagccgctccccggcgcggccacttcctcgccttctccttccttccctttcctccctctttccgtcttccctcttcctcattcccgcccagtctccttcctcccttcctaaccccctcccctcccctcttcctgctgtcacttccaaacccaaggacaaaaccgttacctgcgggccccggagcggccccggagttcgcctcggtcactgccggagcccaggcgcgcgctcggtggccgcccgcctcatccccgcgcgtctgagcggcccggcggcagctgctccttttatggggctcgcaggcagtaggctcggccagggtgtccccagcccgctcgggcggcagcggcgtcaatgcgcgctattcacactccgggctgcggctggtacccctctacacgccccccgggagtgcgcgactgcctgcccgcccccatcctcagggccttggacgggggtaggggtgggagacaaatatggctttcagggcacccactaggggaagggagtcacatggttctggccctgggtagccagggtaagaggggcccaccaagagctgctagcaccttgaaatgaatagggaggtgccggtcaaacacgggagtgtggggttgacttcgaaatacagcaggaagagagctgaacctttcattatcatcatcaccactattttacttatgattatcattaaatagcatctgccattttattaagtgattactatgagccaaaaaattctcttctggtacagaacattttaaaagcctgtgtgttctgggtccaccacctggcactttggttaatacagacagaatcacatcttccctcttctcagtggaaacctctgctggccccattccatagaagaaaagctacccacattagctctgcattcaagggcccttaagtttctatcctggtcctactctttagcctcaaatctgatgcatctcaccctcaagagaccccaggagggggttaagtatttgtctttttattaaagatcagaaagacaaagctcggagaggttaagtaattgccaaaggtcactcagctaagaaatgctggagcaatgccccaggtcagtccaagttcaaagtcctggatcttggtctctccatgctactgtttttagtaaacttctaaggccaagagggcatcacacccttttgagttctggatgatatctcacctcttcactggcaagaataaaacttgaaagaaattggactctctaggccaagaagaaaatcccagagagccctgtttgaacctgtcacctccgggcagctcttccttttattcatatacaactttagttttagtttcaggtggaccacagcaatagtgatgggaaacaatcaatttgactaaactgggattggcccccagcatgctcacatcactgcctggaatggcaagaagaactggaattcccaaggctaagcaccatagctcatgcttacaatcccagcaatttgggaggccaagacaggaggatcacttgagccccgaagtttgtgaccagctttgacaacagagggagaccccatgtccacaaaaaaaaaaaatacaaaaattatctgggtgtgggggcatgcacctgtagtcccagctacttgggaggctgaggtgagaggattgcatgggcctaggagtctgaggctgcatgagctgtgactgtgccactacactccagcctgggcaacagagaccctgtcttaaaaagaaacggaattcccagtgataggtttggttctgtgtccccacccaaatctcatctggaattgtaatccccatgtgtccagggagagacctgtaatccccatgtgtggagggagacaggtaactggatcatgggggcgatttctgccatgctgttctcatgatggtgagttctcaggagatctaagagttttataaggggctcttctcccttcgcttgcttctctttcctgctgacttgttaaggtgcctgcttccccttctgccgtgattctaagtttcctgaggactccccagccatgaggaactgtgagtcaattaaaccactttccttttttatttttattttttgagacggagtctcacacggtcacccaggctggagtgcagtcgcatgatcttggctcactgtagcctctgcctccttggttcaagcgattctcacgcctcagctccccgagtggctgggattacaggcacgcaccaccgcgcgcggctaattttctgtgtttttagtagagacagggtttcactgtgttagccaggatggtctcgatttcctgacctcgtgatccgcccgcctcggcctcccaaagtgctgggattacaggcgtgagccaccacgcccggcccactttcctttataaattacccagtctcagggaagtttatagcagtgtgaaaatggactaacacacccaagaagaaagccaaaagcaattatttgttacacttcacataatactagaatgatttttccatgtgacttacagaagcagaagactatacaatccacactaagcatctgaaacagaccttccttcacaagtgtggaaatgcataaatgcattagctaagagagtaacatcacatttactcctgtctctttttaaagcagacaaagaggagcaatttgacatgagaggttcaccaaagcaaagctggtacaatttccctgtgtggggctcatcagaggactagataagcctgatgctgataagaggcagaaaaggaatgtgtaagttgctaactccaaagtgggggaggcagtgagatattcctgtcagagtgaaagtgattttcaatttcaaataattatattaggtcattcattgtttggaatggagtgtctgtagtacacggcattcctgctgagagggttctcaaaggctgagggttaggaggcagaaagcctgtaattagaagccctgaagcacccaccctctctgatgaagaggattggagtacagcctgtccaggtaatagggctcagctcaggagtgtgtataggggtgtgtgtgtgtgtgtgtgtgtgtgtgtgtccccattccaatttcccaacatgaacatctaattatgccaaatcttataagcttcaggggagtgggaaaatgagaattaaaagcaaacagtgatttagagaaaaaaggtatttgaacccatttccaaaagaagcttccgtttaatacaggggtaaaagagtggcttatcctttgaagcagccagcaaaattcctaaccactcttggattctgagctacacaacttgctagtttcatttgcactcatgatagattttcttagaagccctctcaagactatgggtaaatgcaactggggacaagaaaatgagggcttggtggtgatgtcaccattcttttgtctgtctccactcatatagatgaaaatgggcctcctttgagcaaatctagcttttcttggggccctgatcctatgaattacttacttcgggaagggcctgtgaaaactgaaatttgcatctgcctacagagggaagtttaggaaatctaacttaattcattccacagccactcttgacatgacatatgaaccttcaaccagatgcatgtgttatgccttggtttaattatgagatgaattaataggttttgtgtaatatcctgattaacttatgtctcctgttcacagatggtaaacgtaaaatttctccaggagagggaattatatcctcctgcaacttgaggtttttgctgatctgttcagcgtggtaatacatctaagggatgtttagtccccacttcaaacataaatagctattcctgatactcagatgaaaaagaaaaaaagatgccttaattataacttcactcaactgcattaataccattctatttaaaataacaatactgagttgttggtttttttttttgagcccctgaagatggatggaaaaattaagtctgatttaatctatcagctatgcacggtataacaatattaagtcatacatttggagtgtaagtagctagaggtagtttctacatcaaactcacttggccacccagaacttatattctctgtggtaggtatgagccttgtcctacattttggtcatgttcatttattttttaagtgtaaacagtattgccctaacattaaacagaatgaattcagtttggctttgaaaaaaaaatttttttaatataacatcccgtctcctttattcagtcaacacattttttaaagcacttcatatgtgctgcattgttctagacaatggagatgtaacagtgaacagacacggtgatgagatacctgtgcctgaccagaatcctgacatcaatgtcgcaagtgtatatagagtgcactataattatcagccctaataacagcggtgcaaggggacatattaagacaaatgaataaataagagtccaaaagtttttccctggttttaggatatgctatatattttttccatggactttctatttgttttttaatgtgagtaaggttacaaatggacagcaatgaactatgtttagaccttggactctgcagtctgtctgtcctgagtgggtatccccatgatccatactcacttgggctaattctcagtttcgctaattctcattatctctattacaaaatacaaatgaagaaactgagaatactttcctcgaggtaatgttataaaattaaatgagacaatataggcaaatcatttggactacagtagtgttgctcacccttttcttcgttattgctctaagcaatgagcttttttagatttttttctcctaatcaacccctgctttccagtgaaattgtaataccacagatatactgtatatctgtttaggtattgtaggtagatctgtactttctacataaaaagggtaagttttgtttcactccccaagaaccagtattcacctcccttaggagagacatcacttccctttgagaaggcatggtcaagagtcactttggcactatgtgatatagagtcatgcagtgcttgctaaatattagcaaatataacagtaataatcatcaaaataaacatatgattctatatccctagactagagaagatttgagtaaagtctgacaaaagatgacaagaggcacatcagctctgacacccaggaaaccaaagcctgaatccaacaataaaaagtctgttggaggctggggttgagcataaaccaagaagaccttcttactttcttaccgatgggaaaaagagagacgcaaagcatcagggcagctggacaagggtgatcacctctcttaatgagtcagctaagattacccatcatttacacatgcaaagaagaagcaacacaacaccaaagtgctccagaatagatacttttaggcacagttcattttgcctgaaaaatcctctttctacccttctgtccatccaagtctcatacctacatcaaacccaccaaaggtcccacttccttcatgaaatctttctagcacaaagaaccctcagtcatcagacaaccctgatttaaactgaagggcattctatggaataactaaccagaacatttcttcaaaagtgtcaacatcatgaaagaaaaggcaagactaaggaactgtctccattggagacatgacaaagatatgcaatgtgagacactggtttggatcctgcaacacaaaaaggacattagtggaggggaaaatggtgaactccaaatagtcatggtttaggtaatagtactgtacatgttaatagtacatggattagttaatagccaatgttaatttcctgattttgatcatgataccatggttatgtaagatgtcaacattagggaaagctgagaggagaataaatgggaacacgccatacaatttttgtaacttttctctaagtctaaattatttcgaaattaaaaggtttttttaaatggtgatttactcattcaattttttcaacaaaagtattttaaaggcccacccatgctaggcccttccagaggctggggaatcagctatgaacaaaacaagacaataatccctaatatcatggttaacatagtattttccggattcctttctgcctcagaatagctatgaggccatgctttataagtcttatcctgtccactactgccatgtcaaattcatctgctcttgtcatatctcctcacattagggacaggatatggctcctgttctctgccttttgctcatgggagtggatggggaggtgagctcctatgtccaatgcctggtacgtagcacatgcctagaacactgcttgaacacagtagatctttgataggtgagaggtggtgccatttaaaaaaatatgaacacccagcctggtatggtggctcatgcctgtaatctcagcaatttgcaaggccaaggctggaggaacacttgagccaaggtcaagaccaggctgggcaacaaggtgagaccccgtctctacaaaaaaataaaagaaaattgccaggcatagtgatgcgtgcctgtggtcccagctacttgtgaggctgaggcaggagaatcgcttgagcccagaggttgaggctacagtgagccatgttcatgccactgcacaccagcctgagagagcaagaccctgtctcaaaacaaaacaaacaaacaaaaaaccaaacacgcttgatacagagcctgatggaaactaggcattcacttaacatgtttcttgcctagaatgtaagaatgatcagctgttggtctctgcggactctcaaatgttataattttatgacacgttatgcttgattctttgacaaataagaatgtatgtgtgtttctgtgatagggagagattgtatgagagagagttagtgaattagtgtggaagtagcggaacagagaaatagagacctgaactagtacatcccaatggaccttaacacttcaaaacataagctggtacttaaaagattgcatcttctcactttgaaagacaagaatgatcatcaaaaaagaaacaccaagaaatctctgatgtacttttccagacattagctacttacacaaattaaaattaaaaaccaaatttgtcatatggctttaaaaatgcaacatgcttttgtcgcttagactagaattacatttttcttggaaacacctccctgctggtccccatgccctgaaccacctgagacatttactcactacatatagtgatgtctctaatttcaagatcagttctgtaatgtatttcataagcctggtccgctttcagagttctcattatcagtgaatgtcatttgcatccatctcattataaaagctaaagcctgagaattcatcctggacaaccctcttcactttgtctttaaattctgacaattttcctcctaaatatatttcatgcattcactacaatttctcctgccaatattctcatccaccatgatcttttgcctagactactataatagctttcaagctggctttcctacctataatccacgctgttacagaaggcagagagatctttttaaaaagtaaaaaccaacacaaagtaaatctgactatgtcattccaacagcttgagtctccaaagaacaagatccttaatatgacctaaaaggacatgtctttttatggtctggtgtcttgccaactgctgcagcatcatctctcagtatatgattccagacttgttctgctcaatccgtactggccttcgttcactgtttcagaacattccatgctctgaccacctgggaaaggctctctaccaaagtacccttccttccacctatttattctttgtgtgtcaacttgaacagcaacttatcagaagaactttccaacaaatccccagactcggtatgttgttgacctccaagatggccattaatgagccccatttcctggtattcagactcttgtgtattgtcttcccacagcgcacaaaactggtctggatgactaatagaatataggagaagtgacagtatgccacccctaagattaggttataagacactgtcccttccaccttggttctgtgcattctctctgtcttcctcttggagtattcactttaggcgaagcctgctaccacgtggtaagagccacacatagtgaggaactaaagcctcctgtcaacagccatgtaagtgataatcaaagtccatccttcagccccagccatgctttcagatgactgtatccctgcctgacagccagctgtatcctcatgagagttcttgagccaagaccacccagctataccacccctggattcctgaccctcagaaactgtgtgagatcattaaatatatcgttttagctttctcagtaagcaattaccttaaaacttagcaatagataatgaatatgcttggttagatgcctctgtcatatcctcttgtggaatcttgctccttttgcatatctcacttggtaattacgtatttgtttaacgaaatcgatcagtgccagtctcctcatcagttttgtctcctaatcttaccacagtatttccagaactctgtgacaggcctcaaaaacattaggtgggtgaattaattgtcctagcaatacaactggaagacttcccttcaatcactgaattgctctgataaatttgcttttggtagggagttaacatgtaacgtgagccctaaaatcaatcagtaattaatagaagataaccatgtagagaggtcccccaaccatggcctcatccaccatcagtttcaatctgcagtatgccttcaatagggagataaactgccttctacccacgagtcaattaataacaataaaataggatctgatccaggtctgtccggactgcagtctctctactgtcactgtcttacagatctatgagtccagggcaccaataggctttctcacccttgaaggataattatcatcattctcatgttaagtacaatgtcctgcttattaatagacgtagaggctatcaatacccaatcaggagtccaagtgcccccatctgtttctaaacgtttccatttttaattggttgatttttatttttcatggatgacagacactttattggcctcctctctggaatactatgactattggttgcaagtggaaagaattactaagcaaaatacagccagtagtatcacgaagagagcagacaggccatcagcacacaatgtttaatcaaagctgatgatagctgaggcaagaggatcacttgagactatgaacttgagaccagcctgggcaacatagcatgaccctgtctctttattagaaaaaaacaaaaacaaaaaaacagctgacattagatcctgttatcttcttacatcattctctctcattcgtttcctcaaattcagttattatggtacagaaaagctaagtttcacttccacgaaacccatgagttttagccaacacttccaatgggttggctgattttcaaatggggtgcatgctaaaaacaaacaaacacacaaaaaaaaccctgcagatttgggaccccatcctgatctaccgaatcagaatttccagaggacgagcctggcaatctacaattttaaccaccaactcagaaaatagattatattaccagacataaaagctcatatgtcacctaaaaccccttccattataataagctacaaatccaaatatttgttctaagtcatatgacagaaaactgaggaaaacaatgaatcttctaaagcaaaaaacttaagtaacttcattctcaagtactactcctctgctagattaggcttctcacaaaggaactaaagggccaaattatacatagtgcacacgtcacagctcaagtccttttcacaataggtgaagtttaaaaaaaagtcttacaacaacaaagaagacaaaagaattcttcttggagtccattttcctcagtgaactcacaaataaaaaactgactttagtatctctttaagaatatccctttcagaagctgagcatctaaggaaaattagcagaaatgttattttctcatgtcagttattcattacattaaataacattatgttccaaattagaggattaaataatcctaacagttttcttagccagtctttctcatccttcatgggtcatgaagaagaaggaggttttgaccacaactctcaagctacttttaaatcaatctatctgaaaatttcagggatacttccacctgattgaatgagtccataatattttcagtttccaaaatactaatcataacttgaaaatatttatctacatattactttaaattttttaatttaattctacttgtttttctttgccctctgttgaaatagatttctctctaatattctaacattcatacagtgcttactgtgtgccaggggctacactatgtgatttcatccactacttcttttaatcagtccacactcctacaaggtagggatcgttattccctttttatagatcagaaagtggaagcccagaaaggctacaaaacttgtctaacttctcttggctcatgggtgacaaaccaggatttaaaacacatcttggcctggcatggtggctcacgcctgtaataccagcactacgggaggccagcaggaggatcccttgagctgaagacttcgacaccagcctgggcaacatagtaagaccctatgtgtataaaatatacaaaaagctagccgggtatggtggcatgcaactgtagtcccagctactcgagaggctgaggtgggaggatcatctgagcccggcaagtcgtggctacaatgagccaagattgcaccactacactccagcctgggcgagagagtgagaccctgtctcgaaaaacaaacaaatgaaaacacacatctgacttcaaagcttgtctgtttagcaaaatacaaaactccatatatataggataaaatatttaatatcttcccactgtgaaattaataatactattttaagagaaatatataggggattccctggtacatatcagtgttgattttctatcactttagtgaaagtatcacattactgccgctaaatcagcctgttttgaattaaaagcgtccattatgatggtgcactgaaaaatgtacgcctcttaactggattgtttgtaatacaaaggataaacgcttgaggggatggatactgattttccatgatgtgattatgatgcattgcatttctgtgtaccccataaatacatatacctactatggacccacgaaaatttaaaataaaatttttagggaattttttaaatgtactcatcatcttttctatcctttaataaggagaaactataactgctagaacaaattctaaagatagttctagattctaaaggagccggtcatctgcaattaatttaatgaaactggaggaaatgtaaactgtttcctgctactcccactcctctccccctccagataggaaaagagggacataggaaagaaacagctctgcaaaggacaaagaaaagccaccaagtgaaacccatctggtacaaagtcacaatgatgaggcaggccaatgtgggtgggttttctactatggtgcccactaaaaacaacaaaagacatgtggcaaaatctccaaacactagggaagtctgggaggaagactgctcagtgattagtccagatgggaactactacattcgctaatatgagcatcagagaaagtgattcataaatttttgcatcagcacaaacgaagcccactttttaaaaatggttacgccagtagatctttccttcagtaattcttagggatacaaaactatcagtatggcagatatacagggaataaataaaaacaagctgtccaaggcacttagacagcgttagacctggtactttccctgtttctctaatggactctgtacctgaggtttttgtcaagactttgtacctccaggtagaaaaagcttttatagatcttcaaacactgctaggaaaacttggaaatgtgacagctatcttctttttctatcaataaatcttccctatttggcagagctatgagttattcatagcagaaagctcattttattaaagtattttgagagcttttgtttcccccgtattgttgtattttctccctcacccttaacaacaggacacccaatctatggctggggcaaatggtactaagaactctaacaggactaaggaggggattatttgcaaaggcttgagccttaaggaacgaaacccaccactcagaaaaatctaaacacaagaagcaaaattcaaggaggtgcttaacttgaactcaaaggatcctgaagtgttcaggaacaagcttagggggtctatgaacaccctgaaaatacaagagacatgagacagattaagtatgaagttctggtttcttctagaaaagactcagaatcttgagatgcacaagctgaaaaggagttttagaaataatttacatcaactctcgttttatacatgacaaaactaagacatacagatgtgatatttaccaccttcactgaaagaaaatcaaatgagtttctcacttcttaaatcaagccattgcttttaaaactttattagcaagtggagacagagtcagtcaaactacagctgggcagaaatacgcaactcaactctaacaaaccagtgattcacattaatttaatatacagtaacccccccaatacagtttcacttcctgtggtttcagatactctcgttcaaccacagtttgacaataggtgcttatggtacaataagatatttttcaagagagaccatattcactacatgtatttattcacaataaattttattacagtatatcattataattgttctattttattaatagttgttagtctcttactgtccctaatttataaatttaacataggtatgtatgcatgtcacaggtatgtatgtatgtataggaataaacagagtatatatagggttatgtactatctgcagtttcaggcttccactgggagtcctggaatgtacccctgttgataagaaggggactactgtattttctaaaaaacaaaaccataaaacttaccacgttttatcaaatctgaggcaacaattatagcttatgaagcaacaaggcagaagaaatactgccaattaagttacagaatgccactcattgtagaatgcattttgaattctgaaatattaaaatgtagaacactatgcatcttagaattgataaatatagtattgtaaaaaagtaatgacttataggactcttggcttgttttgttatgctttgttctttgttgtgttttttgtttttgttttttagagacaagctctatctctgtttcccaggctatagtacagtggcaagatcatagctcactgcagccttgaacttttcggctaaagcaatcctcccatctcagccttctggggaggtgggattacaagtgcaagccaatttgccaaactgatttatgactcttgaaagaacacaatatggtaaacttccttttgtaataattaacaggtaagaaagaacttgtgggacatctcataaattaaaagcccttgttccaacacaaaaatgagaccagtaaacgatgagttaattcttgcacaaagcaagaaatcatataaaattattcatatgtatttaaagcattttattttaacacacacagtgttcattcttgcatccatcttttaaagtagattaactttttttgaacctaggttccctgtttgggatctgtagtatctttcatgatataaaccatacttataattcagtgtctatgatttctaatttgggcttatttgaaacacagtgataatgtaaacacacttgcaaaccaatttgagtgctttagattttttatgacttccctttatattttacagtctttacgtacacctaatttaacacaatttttaagcaagagaactttattaagttgtcctaatggattccaataaattttcagggaaatatcagctttccctccccacttacatttcattggtttatataatatttaattaaattatattgttagagtaacaatgatataagcaagtttgaaaacaaacaacagactattggacagcttgcaactcacagtgggaacatcagtatgcaactgaacaccagctttcaaggtgacactcaatgattcttgcccccaggtgttcaagctccagtgtagttagtctccctcccacatgaagagagctggcctgatgttgcagaaatgatggaatgtgattcctgaagtgaggtcataaaagacattaaaacttccaacttgctctgtctttggtcttttgttctagggatgctgcctgccatgccatgagatccctcaaacaaccctagggagaagtccacatagcttcctgccaaaacccagtgtgaactgacctgacatgtgagtgagacaccttgagagtggaccaaacagtcaaatcagaccaacctggatttgaacccagacttagccacttagtagcagagtaaccctgggtaaggttactctgctctctaagattcaatgttctcttcagtaaaattggttgatgatggtgctgattcattaggtagttactaggagttgttacaaattcaagacaaatattgctggcaattgatagttactgactgcttacttgtatgagaccagtatgccaagcctttatattcatattcattattatcatggttacaagccttcacagtccttctcatttactgaagtagataatggtgcctggcacatgggaaatacttaataaatgtggcttccagcaatggcacatgtaatgacatttaggctttcatgcaactggaaactgggctcctagggaacaagatgcatatctccagaggctgaaagggccatcggagctcctgcatttacgctttcccattgtttcactcttctcaaagccgtcctcctgactaggtcaggaaaaaccaactggaacggagtgcagggctggcaaatgacctcatgaagcctggaccagctcccctgccttagacaaggctacgaaaatggataacaaatcttctaagaaaaaaaaaaaggcagaacaaatctattttcaagattctttccttccttttacaattacaatgtgctgcatgaatgtcctgattttaataattccactgccatcttctgcccctgtttttggccttcttccatatctaattctgatttttcttgtttgctgaatagatctagccaaggcaaagagacaatgagatggcataagaatgaatgagattttaaaaagagatggcttataaataactcccagcagaaatcttgaaataactatggacaaagaattgtcatccaatttacaatagtaacaacatgaagaccaaaaataaataaataaataagtaaaaatagtaggccatgcagtggctagtcctgaatcccctgggaaattaaacatagacacagcctcgtctcatgttcaatagcaacggaaagatttatttgtgtgcattccgatgtcctaacagtactctaacctgcagctagggtctttagcagagggattagttgtcaaaagtgctcttaaatgatatcacaatttttttctcatcattaaatgcctgtgtgagaataagtttactggccccatactgccaaccagctcatcaatggcagaaacacaatatgcttccaaagcctgtagaccaagtgaggtgacaacttagagatgagccagtgggggctccatctcctgaatactcttacccagaggacctaaaaacaatcgaccttcagtcaaggccagctgaactgctgagatactgtgacgattatttcattctttccaaacctagataacacgaataggctccaaaacaagcctgcaagcacatcagcatacacacgggtgcacacacatatatacgggcacaaacaattcattaaaggtgaaacacatctctagtgacagctgagcaagagaaaaaaggtgcatgatttaagacatctttttccattcccttttcttcagtatctgatgctgtagcttatgtcaggtgcaggctaactccaatagaaaataattatttttatcaatagtctatcatattccttaatgttaatccacaatatatagccaaacctagtatgtcaatactaattagaaatacataggaccattcatggccagaaaatatttcaagacagtagtagttaagaaaatcaaaagcaaaacaaaaaacaaaactcagtggtcatttgtgttcacggttgttaaagtcagtgttttgagtgacttcacttctcagatcctcaacttctccagtatgacagtgtggctcagtttggacaacactactctcattaagaaacattgcttatggtcgggcacggtgactcatgactgtaatcccagcactttgggaggctgaggcaggcagatcacttgaggttaggagttcaagaccagcctggtcaacatggtgaaaccctgtctctactaaaaatacaaaaattagccgggtgtggtggtgcacacctataatcccagctactctggaggctgaggcaggagaattgcttgaacccaggaggcagaggctgcagtgagccacgatcgcatcactgcactccagactgggcgacagggcgagactccgtgtcaaaaaaaaaaaaaaaaaagaaacattgctatcacacaacggacagtggatttggaggaagtccttaccacatgatgcaacagtaatatttacaggcagagaaaaacgtcataatattttaagtttgtggtggctcacgcctataatcccagcactttgggaggctgaggcgggcggatcacaaggtcaggagttcgagaccagcctggccaatatggtgaaaccccatctctactaaaaatatgaaaattagctgggcatggtggcaggcacctgtagtcccagctactcgggaggctgaggcagaagaatcgcttgaacccaggaggtggaggctgcagtgagctgagactgcaccactgcactccagcctgggcaacagagcaagactctgtctcaaaaaaaaataaaaaataaaaataaggacataaagcaagtttggttaatataggcacatgtcacttatctacatatattatctatgtactcagaaaggcatgaaggctgttaacatcagaacattaacagggactgagtagtaagattcagggtgatttttatgtctgctgttttgctcaccttttttttttttccatagttaacacaaatgatctctgtgatagttacatgtaaatggcagcaaaagcaaaaagcatatacctcccactaataacccagggaaatctggttccaaagttaaggctttgtctaaggtggcatacatactcagaagtcagttttcccaagtccgtgttactgggtttttgtttgtttgtttgtttgtttgttttggaatgtggatcatataattgtgtccaagagtttagtcattcagcaataaataacccaaaagacaatatatttttaaatgtatttttaaatggcattgcttctgaaagcagacaaaactggcaggacctctgagatgtcagaagaggcccaggacactcataatttttgagacctctcctgacccggtgatccacccgcctgggcctcccaaagtgctgggattataggcatgagccacagcatccggccgtctttagatatattaattaaaatcttgtgaatgcatctacatggctgtacatcgacattgtttggagatcatgataaaagtctacatttgaggccattcctgctccctgctccctccacagggagggagctgacttgtaaaaagtatgaaaaggaatgacatacagacacttttaagtggcattgcttctgaaagcagacaaaactggcaggacctctgagatgtcagaagaggcccaggacactcataatgttaagacctctagtatgagatagctaaatgtggttttaaaagatgagctttttttagatatattaattaaaatcttgtgaatgtatccacatggctgtacatcaacttttgtttggagataatgacaaaagtctacatttgaggccattcctgcttcctgctccctccacactcacgctgactgtgtaaaaagtatgaaaaggaatgacccccactgaccatgaaaaaaaaaattacacaggcaaggctgatggataaagaccagaaaatagctctaacagaaggacaactactaaaatttaaaaataaaaaaagtcctactacggaaagcattgatggaaagccctgtaattgtatcccaaatcatttcatcacatctaaccaaagaagaaagaggaaaaggatggctgggcacagtggctcacaccagtaatctcagcattttgggaagctgaggctggtggatcacttgaggtcaggagttcaagaccagcctggccaacatgcgaaaccccacctctactaaaaatacaaaaattagctgggcgtggcagcacacacttgtaatcctagctacttgggaggctgaggaaggtgaatcacttgaacctgggaggtagaggttgcagtgagccatgatcatgccactgcactccagcctgggtgacacatggagactctttctccaaaaacaaaaacaacaaaaaaaagggaagctcatgcaatcttcatacgttgctgtaacgtatcccactggcatgttatgtgatatttatatttaatttaggctgaacatgactctagcaaatctctttggtagttaaatgtttccttcaaagggatatcaggatataaatcctgaggtcagaatccatgtcaattccaacacagaaacctttcaaagcacagtcctaagggaatctatttaccgggtaaaggacacaaccagaggcacttaacgtggaagactggtgaagggccaaactcccacccaaagaccaactcatcattcattcttcacacatctgggtaaggagcaggcaaggcacttgttgatagtgaagcaggaattgtttccccatatcatttccctctcgtttccccagttcatatcccaagcttcatggcaataaaaataaaatattttttgactggacacttttttttttctttttggttgtgcacaggagctagaaagcccttgttatatccatgcaggcaatataggtgattccttgttatggttgatcaggtaaaaccttaaccatcatcaaatcagggcacataatagtgtcaacttggtgaaacagtgagtcggggagtcactgcgtatgagcaaggagctctcacttgattatactcatgctctgctcaggttggctgatttgccaatagatttcatttctatagcagtgtactggataatagggactgcacactcaagtctaaaatgtattcattcgttctacacctgtttagcgcctgctctgggcaaaaccttgtgcagggtgctgtatgttggctcccaaaggagaaggattgctgccaagtttgctctagggcttgagccatgttgactattaaataccagttcagggtgttcagtaaagtctctgataatgctccataactttctaattagtcaagcctttaaatagaaagaggtctgtcattttattgtgatttccagggttactttatcctccgcatttccaaagtttctatgacctatagcaatgagttcataataatatccacgtataattttattttccatatagagcagttgacatcaaatagcagcccatgtgctaaatccagccagctgataaatgttttgtttggctcacacagtactttaaattctttttaaaaataacttgccaagcaacccaagtgcctatagatagatgaatagataaacaaaatgtggtacatacaattcagccttaaataagaatgaagttgtgacacatgctacaacctggatgaactctgaagacattatgctaaatgaaataatccagacacaaaaggaaaaatattgcatgattcctcttataagaagtacctagaatagtcaaattcatggagacagaaaggagaattgtggttaccaggggcgagagggaggagaatggagaactgtcatttaatgagtacatagtttcagtgtaggatgatgaaaaagttcttgagttggatgttgatgatggttgcacaatagcataatgtatttaatgtgactgaaatatgcacttaaaatggttaaaatggtaaatttttgttatgtatattttaccactataaaaaagattgaaaaaaccttctccacttatacaaatgaatatgtgtgcactgtggaaatcaaaactgtaggtaagtttaaagtatataaatccttccacaattttaaaggatcctttaagatttaaatgtttaagacggcaggcacggtggcttgtgcatgtaatcccagcactttgagaggccaaggtgggaggactgcttgagcccagaagttggagaccagcctgggaaacataatgagaccctgtctctaaaaacaaaaaataaattagccatgcatgatggcatgcgcctgtagtcccttctacttggggggctgatgggaagatctcttgagcctgggacatcaaggctgcagtgagccatgattgtaccactgcgttccagtctgggcaatacagcgagaccctgtctcagaaaaaaaaaaaagtttcaagaatatttatctggtgaattatttttactgaaatacttgaattatttttactgaaatacttagatgggacaaggcaaggaggactttgcaacattagaaagatgagaggtagtatactctctcaaccactaggtgagctctttccattcctacagtgcttctttctttctttattatcattattattattattattattattattattattattattattattctgagacacagtctcactcggttgccaaggctgaagtacagtggtgcgatcttggcttactgcaacctcagcctcctgggttcaagagattctcctgcctcatcctccaagtggctgggactacagacatgcaccactatatccagctaatttttatgtttttagtagagacagggtttcaacatgttggccaggctggtctcaaactcctgacttcaagtgatccaccagcctcagcctcctaaagtgctaggatcacaggcatgagccactacacctggcctttctacaatacttcataaaaaaaaaaaaatgtttaatcagctcagattaaaaatataacaatgaagaaaaattatatatagcttagaaattaaaagttgcactaaagtataaagaatgtcaaatattaggaatgccatttatatttaaggcttataaatcagattgaacacatggaaatgtttaaaaatgaaattgtatgatatccaggatttgctacaaaataattcggtggcaggaaaataaaccagaatggtgatacagatgaaataagattggctaaaagttgaccactgttgaagctacatgatgggcatctgggcatctaagttcattgcaccattcttttgacttatgtggaaaaaatccagatcatgttacatataaaaacaaaataagcaagaaatagagactaaactctttttctcactctcctaccccgtttcaggctgcctggttgtttggggggctctttcaaatacaatggttcaaaagaactgctaggacaaaacaagcaaaccaaactcaattaccgaataacactcaattttgccaatggtatctgtagaaacggaggcttacatttttttggaaagcctcaaaatcagatgcacttgctaattttgttaacttgaagagaagaaacagaaaagtcatctctttttccaaaaacctataaaccagtttgctttttattgcttttcattacaattttgaacatgaaatatttccagaaaatgaaaaacccaaatgcacctgcctgcattagggattaacggcttggaaaattctattttaaaaattgcagtgaatgaaactgagggtcattttcctccctttactcaactgtatacaaattattttatataagttttcatcaaggcaatacaaatatatgatacaaatttttcctcaaattttgtgtttcagaaaatgtggaagaaataaatgctctttaaatggtattttaaatgatgaatacatgtgatgagggcttatcactcaaagaaaatggtatagtgttatttataaaaggatccaaatgatcttaaattgaatccctagctaaaatttcagaagactaacaagtcttactacttaatgagttcactaaatgtatcctttaaaagcaagtaatgattactagaatataccataggtttattcagaaaaagcgataagcaaccaacttctctgagtaatttattacactttgttttagacaataggtcaaataatacagcaaagggcaactagatttcaaaaagacatttggtagggtttttctataaaggaggagccatgcgtaacaggacaactacacccataggtgtagttgatgaatacgttttgagagatgtcactggcctctgtgtttgattttgtcccattaataatgtgcacatgtattaaacaaaaacataaatggcatgctgaccaaaaatagctataagacagtactgatcatttgatgcacaaaattaggcaccaaatgagggctttaactcattttttcagttttggcaaatatacccaacctcataacagattaaaaaactaaagttctactctttgggtggagataaaaaataagcatatatgcacaaattagaaaaaagtatacaggagaaagggacagaaaaagattatcctttaacaggacaataatgtgaaaaacgaggaaggtaatcatcctatttaattctgactaacaaaaatgaggcagagtagactagtttacaatactgagcatttattatgtgccaggtaccatcctcaatactttaagaataatatcttatcaatatcaccctatagaaaggaactataattatctcatttttataaacaattaaattaatactctaagagatcagaggatgatctaaggtcaaatgaccttaaatgaggagagctgaatttgccaaggctaagagggcagtaaatgtaaacaccaggaactaggaacaagcaaatggtgttaaagggaaagaaagccagccaatgtttccagagtgcattctattgcattgcacaaaatgaggggaaactgaataaccagctggggagttactactgtccactccaggggaagaaagactgcatcacagggtcacagacatctatccttcaaagtagttaagcagaggcaagaggctgcctgtcaaacacggagacaggactcaggcattgagtgcaaagttgaactagagaccttgagtttctctgatcctataagtagaagcagccatagtagtggtagtagaaattaccatttatgatatgctgttttcctttattatccttattatccttataacaatattgtcccataagtattattatgttcatcttaaacgcagagaaatcaaaggcccatagcaggtccaggattcaaggtcagacctgtctagttacaaaaacccatgcccactacactaccttttttccccaaagcagcaactagatcataggaacatttgatttgtttccagaagggtcaaactctggccaaagaacagattgtttctctccaacatttacatttctcagaggtgtagtctattcaagaattttaatttagacttgcacgtattttgacaagtaaaaaaaatgttatacagatatgaagacaaagttactcatcttatccctatctgccaattacattccccaaataaccagtgttaatatttttgtgtttgatattcattcctttcacaaaactataaacatatagatacatatataaggggttaatttattttaatcaaaataaaaacaaactgcacatattatacaactcattttttctacttaatattatagacatatttaaaatcattagaacaaaaaaattgcaaaccaatatttcacaggaacaaagatgcaaaaattctaaataaaaatttaaccaatcatattcaacaataaataaaaagcataatacatcatgagcaaatagggaaatagagtttatcccagtcatgtaagattattttaacattggaaaatctattaatataatttatcacactaataaattatatatcacactaataaactacataaaatccacatagtcctctcagtagacacagaaaaagtatttcagaaactcccacatttattgctgatttaaaaataaaaaaaaaactcctggtaatctataaatggcaaagaacttcttcaacctgatgaaaagaatttatgaaaaacctgcagctaacatcatagttaatggtgaaagagtgaatgttttttccctaaaattgagaacaagaatatcttcattacccttttctgtctaacactttactagaggctatagccagtgcaataaagcaaggaaaggaaataaaaagcatttagaatagaaaaggaagatgtaaaacttttattatttctcagatggcatggttagctgtgtcagggtttggcaaaatgtggcagttttgttattaagtttcataagaacacagtcacacccattcacttgtgtattatctacagctgctttcaccctactaattactcaactaccatgggcagttgagtaattgccacagacacacacaagcttaaattatttactatctggccttttaagaaagtttgctgacccctgatctatgtagaaaatctgataaaatctacaataaaactactgggagtaataagcaagtttagacacactaaagaatacaagatcaatatataaaaatctattatatttctttctgcttgtaacttgtaatcagaaatagaaattttattttttattttttaacttttattttaggttccgggatacatgtgcaggtttttacatatatatatgtatatatatatacatacatatatgtaaactgcttgccatgggggttttctgtacaggtaatttcatcacctgggtaataagtacagtacccaatagatattttcaggaacaaaaattttaacacagcatttatgacagcaacaaaatatataaaatacccagcagtaaatctgactggagatgtaaatgacctgcatagaaactaaaaaaaaaaaaaaaaaatgtactgagagaaattttaaaatctaccctattcatgggcaatacttttaaaatgtccattctccacatattcatctatatctagatattcaacgcaatcccaaccaaaatcctaccatacgttttgtcaaaatggacaaagtgattctaaaatttacatggaatattgaaggacctagaatagcaaaaacaaatttgaaaatgaagaataaagttggaaaactaatagtacctaacttcaagacattataaatctccagtaatcaagacagtgttgtactggtgtaaagaaaggtgagtatatgagtgaaacagaatagagaatcaagaaataagccctcacatatatggacaactaattaccaacaaagatgcaaagacaattaagtggagaaaggaaatcttttcaacaagtgacactaaaacaattggactttcacatttaaaaaaattaacttcaactcggaatggatcatagacataaaactaaaaccgaaaaccataaaacttatagaagaaaacttttgtgactttaggttaagtaaaaacagatatcacaccaaaaccacaatctattaaggaaacaattggtaatttgtattgcttcatagttaaaaatctctgttccccaaaagacactgttaagaggatgaaaacgtaaggcacatattgggaaaaagtatgtacaaatcacatatctgaaaaaggtcttatattcagaatctatagagttccaaacaaaacaccaactaaaaagagagtaaaatatttgaattaaacactttaacaaaaaagacatatggatggcaaatgagcacatgaaaaattagtcattatagaaataaaaattaaaaccataatgaggtaccaagatatactattagaaaggttaaagttaaaaagactgaccaaagcaagtattgatgaaaatgtggaagaagtgaaactctcctacactgctgggcaggaatataaagtgatgcaatcactctgggaaggttaagagatttcttaaaaagagagatgaccatgtgacccagtaattccacccacagatatttactcaagagaaatgaaagcatacatccatataaagacttacacacaaatgttcatagcagcttaatctgtaatagacaaactggaaacaaaccaaatacctatcaatgggtgaataaacaaacaaaagatgatacatccataccatgagatactactcagcaacaaaaatagtgagctgttgctatatgctacaacatgaatggctctcaaaaaattctgctagtgaatgatgtataattcactattatgctacgaatgaagtcagattcctgatgccacaaaaaaaatacataccacatgattacattcacatataattctagataaaacaaacttagcaccagataacatgttactggttgtcttgaaatcgggagatacagggtagaggagagtgattataaaggggcacaaggacatttttgggggagctaatgtatgttcgttttcttaattgtggtgctggttttatgggtatatgcacaagtcaagacttatcaaatcatacattctaagcatggacaggatattgtatattaattctacctcagtaaagatgtttttagagtcattagatatttgtctaattttgttttctaattactttatgtatatatacacacagattttataaaatgtagagcatgcatacttagcatttttagcggttttctgtttgcttcttgtttctaaatatctaattaatcaagtaacacgtattaataacctgtttgataataattctaacagtggccctctgaaaattcagctcagggtgctagaacaatcaatatagtgacaccaatatcatgacatgtgtgacacattagcatgaaattagtggtgatccttgtcaatcctacgtagacaatgctaatcaatccccgcactcttcctctctgagcctgaataaaagattccagctctaacaggctggagctaatacaaatggtgaacccgctctgccatccaggggtcttgttgatgatgctgatgatgcctgactgaagtaggcaaatacgtttttatcttcatctttttgccaggctgtctctgtgctatcttgttgctttgcttaaatcaagaaaaatgggcgttgtactgctatctgcattttgtcttgcatttaagtaacggtttcctttaagagccaattcagaactcatacattccaggaagcctcctattgactaagctcaggtcataataaacttgactttttctgaatcctttcactactagattccttgctacacaataccacatttaggtatctgccaccaggattattctctgagcttcacttttcttacctgtaaattgatacttatattgcagagttgtcttcaggactagagatgatgtatggttacccctgggatgtagactccacaaattcagacattttgtctagtttatataaccctagtgcctagaacagtgccagacacagagtaagtgttcaacaaatagctgtaagtaaatatgtaagtagtctttcacataccatggcacattaagttcgatccacatacacacttaatactctataataactcagctacttgaagacagtcaccctaggtgctctttttgtcccttggagttacattttactcagggtttctatagttagaagtcaaggcaaatatcacaggcagagctggactagagtgaaacaaatgaatcataatcctggaatgtaaatttaaaggatacgccaaaaaaaccctccacatatgaaagaaataatatttcatgcaatattttttaaaataaaaataatgcaaagaatccattatgaataaaacatcagttttaaacaaaggcaaaatcagagcagtgcaggactgagccatatcaaagcctgaggcaaaatgaaaaatcaaacacggctcctatcttcacttaaaataattttgattaaaaaatattacattaaaatattatttatcctcattactgaggtttctagcactcccttcaattctgtgccggtggtgagtgcctcctcgtgtcaccccaatcctggccctgcacagctgtcaaaacagtccttgaagaatcccttaaactatccacaaaatataatattctactctcactaaattcaacaccaccagtttgcctttagtgttagaacagtgctacgtttctccaggtgagccctggatgaagaagatggcttacacttaaggagccaggctgtatacaaaatgtgtgtctttacacagcagactcacacttggctcatcaaggtgctgatgccatgggaggcttctgggaactgagaatagtcgaaccatgtctctcatctcaccctggctcaggcacagactctaaggcaggcagaatcaaccacattcttttatttgcctttattcgctcctgtttgtggtctgtctctgtctctctttctctctctcacacactctcacacacgacttgtgtaacttgaatgaataaataatgtgattctactggaaatgcaatgctgtccgccccttggccttctacccagcatgcctgcttgttgagcgactgacgggttctgcctccatcctcaggagcctcagctcccacaaatcactagtgatttcctccagccgccaagacaaaggcgactctggcaaccaggctatgtattccttttgctttccctaagcacccataccatgttgcttcccataaattcacagttttatcctgagatgaaatcgcaccatttctgccaggaatcacacacagaaacatggttctgttttgtttctggacatactgtatttgataaaattagaaagaaatcaccctaccaacatttgcacacaagaagaaagggaaaaaaaagaggagggtgaaaaatcaaccagctatgagatccagtatagagaagatatcagaaaaacattttttgcaggttccaaatcttgaagtataaaattatcctctcctattcttctttgttcccacttgtggcatctagccaatcactaacaaatataagagctggatgccaacttcagtaaacatatttaaccctacaaggagagacagtcatgggggaaaatgaaatcttcatgggtccaagtctctcaatgagaacagatattcaggccggatgccatggctcacgcctgtaatcctaacactttgggacgccgaggtgggtggatcacttgaggtcaggagttcaagaccagcctggccaatatggtgaaaccccatctctactaaaaatacaagaaactagcggggcgtggtggcacatccctgtacccccagctacttgggaggctgaggcacgacaatcacttgagcctgggagatggagattgccacaaggtgagatcgcgccactacaatccagcctgggtgacagagtaacactctgtctccaaagagagagagagagagagagagacagagagagagagagagaacgaacagatattccctgcaagctctcctaaagcgatgcatttttttgcgggggaggggtgggggtcactaatacaaaacatagacttggcactgagcctcccaaagcagaaagaagattggataattacattcatacacatatccattgtgtatgaatcacattgtccagccccaccactgtgcaaatcctggagtcagaacatctcagattctaccagctcatcccaagtattttccagataaggtaacagaggcttagcaagaccaggtgacttgtcttacccaggtcatgatggcagcaggtgcaaccatctacccaagcttctgccaaaaaactaggatgctttctgctgctctgtggtgggaccatttgatcccaggactgccacatatttgggccttatacagttcctttctgtggttaagtgaagtgattacccatgccctatgactaccagatacaccacactacacaagtgacttccaaaatgcagccaggagtccccacagtcacaaatgtctgttcttagaccctctgagacaactgtaacagggataaacacgaatggagaatgatccataaagaactctctcactggccggactcagtggctcacgcctgtaatcccagcactttgggaggccaaggcgggtaggtcaccttaggtcagcagttcgagaccagcctggccaacatagtgaaaccctgtctctactaaaaatgcaaaaaagtagccgggagtggtgacaggagcctgtaatcccagctactcgggaggctgaggcaggagaatcacctgaaactgggaggtggaggttgcagtaggcgaagatcacgccactgcactctggcctggggaacaagagcgaaactccatctcaaaaaaaaaaaaaaactcgctcagtatcattgggacattaaaaaagccaatgaaactagacaagctcactggcactcttttttcattaattactgtatcttttttctgattaaaaaattataacaatttcacatgatcttatgaaactattagctctctgagggcaaagactttttctgcctcgttcactggtctatcccaagtccaggacttaactccatattaaataaacatttcctgaacaagttttaaaaagaaaaatgtatctgttcattgagaaagtcctgaaaacataggaaaaaaatttaaaatgaagcaaactctcccatcaattagcaacacagagataacaactgttagcactttccagaatgtattctgtacatgtacatacaagttttcaatctaatttgagatgagactatataaataattttgtatcccatttggtttgtcttttcttttttctccttttttttttcttggccaagtaatctcgcatcttgcttttaattttaaccttctcttcagttctctcttcttcaattcaagtgcaatgacagctacagacatcagaagtgagcaaatcgatacacagtgacccaaagtcaaacaccaaaagttcttcctggagtcaaacaacttttgcagaataaaaagaatcctctgaaccagttcttccttactcctaacacaggttatttttttcaattaacaagtcacgcaaacaccaggacaattagagctgtactgaactttgtggtattttctgcacataaagtaaatatatctttctaccaaagcatgaataaagaagtgaaggacaataaaaaaaaatatgtggcagataccaatcttgggctatcagattactcaagcacctctgaatgcttaagactgacaagtcgcttctataagaatcacagatttttttgtcagttgtttctcttacagtgtgcacaccggtttccacacattaatgtgtacatttcaattcagcagccttccctggtgatacctctgcttgcatatctaatagatatttagattcaaaatacccagagttaaacaattatcttccccttcaaatgggctccacctgcaagcctgtcccatctcagtaacggatgactccagcccttctctgagcttagggcaaaagtcaggatattaatatcatccttttctcctgtcttattctcataccacccatcaaaaatatctacacaccctgtgccagctcccatcaccactcaccttgatagctgtgcaagcctcataactggtcttctgcatccaagtttgactccctacagtctgagaggcacactctatatccaaagagcatccagaatcattctttgaaatgttgagtcaaaaagggggcagcacaaaggacttttctggaatgatgtagtgacgatatgacttgtatatgaacctttactaaagatcacagaaatgtacatgaataagagaattttactgtccagtaaaaaggaaaattactgtacaagaaaaaaaaaggcaaatgaggccacggaagttctctgctcaaaaacccaaaaacctatattgtacatgctgaagttgccacatgacccgattctctattactgctttaacttcatcttctagtactttcacttcctctgctcactttgtcccagccacactgtccctgcccccttgctgctattcatacaatttaggcatggtcctcccttagtgacctggcactggctgttccctttacctggaatccctcttcccctgccatttgtgaagttaatactctccactctatctcttgcacaaacatcacattcctaattaagccctactgaaacctgccattcatctcccatcagcatacccaataccccttaccttgctctatttttccttttccattcacaggcattatcattttcagatataccatataactcacttactaatactttgcggtccttatctaactctcccttactgacctccagctagaatcttaaactccctgagaacaacaattttccttccaatcctgaatatattcctgacacttagaaaagtgccaggaacatagtagatgtttgataaatatcttttgaaaaaaagtgtacacaactggaacctagtgtatgtcaggcattgcactagcccctgtggtagattcaacatgtaaaatgactgttattttgttaaataaatgggttggcctacataatcccccagtcctctctagctcataaatgcattccaagtgagtgttttagacatgattataggctgtacttgaatgtaagcgccctgaaggcaaggattttaggctgctttccagctactgcattccctgccctagaacagtacatggcatagagaagcatgcaatatttagtgaatgagtaagctccctgtgaacaaggaataagagtcttgtatgtgttatgtttctgattctacccagcacataggaagagcaccaggcacgtgggagaggctcggccctggttatgtactctacctagtctcctcatggttggttcaaaaaaatcacagttagcaacaatatgcacaggccttcctcaatattctcaggagtagtaatggagaggatgattttaaacatgctgcataagcgctttacttcaggtggcagctctttggaattcctattaggtgcatcacatcaaagagcggctctctgatgttgacatgcctgacgattctgagtacaaaatccaggtcaaataagacttactgttgaaagcaagcttctccagagaaattgcagggatttccctttgcatcctggttacttcaattctctgtcttgaactttacaccaaggccactacgaccccaaagcctcatggaagtcacctcagcagtcatctactccaatcacctctgactggccatgactgttaaaggttttgcttccatgaatgtgtgttttccaaagatacatacgccacatcagcaaatgaacgctgacatgagacatgacttctccttctacaacttctagaattacaggtatcattgtcacaccagtccatcagcactgtgcaacacagacataatgtaaaccacatatatgattttaagttacgtaatgttaaaaataagtcaaaccaaacaagtgaaatgcacttaatagtgtattttctctaacccaatatatccaaactactgtaatttcaacatgaaatcaataaaaaattattaatgagatattttgccttttatctctcatactaagtcttcaaaattggggtccactttacactgaccacgtatctcaatggccccaacagtcacatgtggctagtgaccactgacctggacagtgtgagtccagatgtcaagcaccttctctcccaagttgttattgctgctcttagatttacactatttaaggatcttagaactgattttgaaagtcttctaacctatgatgacactactttcattactctcagcaccaaaacatgcgtcttgcaagacagctgaatgaagctatgttacagtgggagagggctgctaaccaggatagagttaccctgtctctcagagtcacaaataatatatttgtttctctaatctctaactagaaccccattttgttgaattccagtgacattcctaagattctaagaatgatatttcttactgacagcagggaaatgggaactaactacaaggttttttttttaaacagctctgccaacaccactaccaaaagataaactgaacagcaacagaaaggaggttgaaagcaggagaaagttcaagtacaatcaccttctcactataaactgcactcccatggaccagctcttagtgtttgaacaggtacaaaatgaggctgaagaagaatagggctctttaaggactcaaaggaatgatctaaccaagttttaaatgaagaagaactaaagaacacattcaggttaggtgctaattcaccaggtgaaagttgttttgaaaatctatactaagaaaagctctgtcattttctccctgaagatgagactgtgacctctactagtctttcaaaggtgaaacagatcacaagaatatgaaaggcagttcaatctggagaactttccacagtgacagtggtgtgaagttcatagcaataaaataataattaacacatcacagcacatccagactctgacattctctacccctatttccattagtcagggcctcaaaaatctactcttgaaaaaaaaaaaaaaaaaaaaggcaaactggcttaaagtgaatttttttcctttccatggaaggttgttatcaagcattgcccagcctacagaatgagctactttggcctaattctgacagctgactcagcagagaccagttggaacaatggttttcaggaggccaatgctggaattggtgaggctctgacagtaccctgccaaagtcagcaatttctttaaaatagggtcagcttataggaacccagatgctatatctattggcctggtttcttggagaaagaaaaaaaccagactacaacatacccactatcctaaaaacagccaagacacaactggcagcaacctcagtagacctgagcgataagcagtgtttgacacaaagctgggaagccattgatttacttagcaattactcaaagatttcacattcaagtggacgagaaacctaggaacaagacacaggtcacagctcttttggcctttgaaaaaacatataaaagcagaaggaaggaagcaagtacaacacatcctcacatctttatgccctcagtctacctaaaaataaatttgaagtgtgtggtacaaagattatcaatgactacagcactaaaataaatggaaaatgtaataaagatatagttcaacaaacatttctagattcaggatagtgcctcgcaaaactatatttgtgatattcttgccaagtcaagtataacagtactcatttttatctcattcatttatccattcgaccagttcatttaaatctttcttgtaccaggtactgtgctagacactggtgctataatgggaaactgaacccaacaaggacccgcattcagggaccttcatatccattgtgagaaaggcagacgggccaaattgattcacctaagtcagtaagacttattgatgtgtaataagaactaccattcactgaatgcctatcatgtttcaggttctatgtgagggactcatttaatcctaacaacatcagcaattagtcattaagaccatttatagatgaggtaactgagccttacagaggtcaaatgatttgccagggtcattcagacagtcaaggacagagccaagatataaacccagatctgtccaactcctatcataagcttaatgtctgaaaataagatatcatcttggtattaaaagaatcaggcaaatcaatggtgagcaggactgactgacagcttgtgcaatgcattaaaatgtatgattataaacaacccaattttaaatgtggataaaggatttgaacagacacttcacaaaagaaaatatacagatggcaaataagcagatgaaaacatgttcaacatccttaatcatttcgaaaatgcaagttaaaatcacagtgaaatgtcaccacactgctagaaaggcaaagaaaaaatgtttttaattttaataccaagggcaggtgaagatgcagagcttctgtaactcttagatgttgctgatgaaaatgaaaaatggtacagccactttggaaaaagcttgacagtttcttataaagttggacatatatgtgccatactacacagagatctcaattctaggtatctacctagcaaaatgaaaaccactgttgacacaaatacctatctaatacatatttagttatctctctggccctctgaacctattctcttgctgtctttgaagtctcctttagcaactttattcttaattcccaaaaatgagaacaattctactgccctttaactggtgaatggctacacatactatagtatattcatacaatggaataatatgcaacaatacaaaggaacaaaataatgacacaagcaaaaacacaggccgggtgcagtggctcacacctgtaatcccagtactttgggaggctgaagcaggaggatcagcggagcccaggagttcgagaccagccctggcactatagtgagaccctgtctgtacaaaaaatttaaaaaattatcagggcgttggtggcgcatgcctgtaccctcagctacttggatgactgtggtgagggtatcgcttgagcccaggaggtttaggttggagtgagccatggtcatgccactgtactctagcctgagcaacagaaagagaccctgtctaaaaaaaaaaagcaacaacagggatgaagcttaagtccattttattaagtgagaaaagctaaatctaatacctttatacactagattatcccacttacatgatattcagaaaaaaaggcaaaattattaggaatagaaaatggatataattgcttggaggaggtggaaaggattgactacaaatggtcagtagaaaataattttaggaatgctgatttttaggggtgatagtattattattctatagtttgaatgaagtggtagttacatgattgtatgcaactgctgaaactcagagcactgcataccaaaaagagtaacttttgttgcaagttaattttcaaaatgaatacaatttgcttcaacaaatgtgatttgaatgacagaaattaaacacaaagatacacaaaaatactaaatacacaaaatactaaatacacaaaaatatacaaagatacacaaaaatactaaaattttgcctaaagccatcccaaactacaagacgtattcttaatgacaaaatgttggaacatgaacaatttcaaattggcaagtaacagattttttttttttaacaccttctcactagttggcaagcagaacagttcgctccaatatcttcattctgcattctggaaaatgcaaacagggcacagggaagcttctggtatgggcgaatgaaggtttctccttagcctgtaacaggtcacaaaagctgatgcacagtttttcttcacaggagaagctaaaatttcccaaaggcttgctgctttcccattatggaagaggcactgtaagaacaacctggtgaattaccccgagatccctaactattgctgtgtgagggctttgcttttgaggttggggttgaagctcatttgaaatctttgacattccccaataagatattgctgggcccaagactttgctacttttttcttaatgccattgggatacagatgctcctcgactcactttggagttatgtcccaataaaccactggtttactgggaacacacctaacctactgaacatcatagcttaggctggcctatcttaaacgtgctcaaaacatttacattagcctagagctgggcaaaatcatctaacacaaagcctattttataacaaagtgttgaatatcacatgtaatttattgaatactgtactgaaagtaaaaaacagaacagttgtgtggatactcgaagtatggtgtctactgaatacatatggcatttctttgccattttattttattattacttttttcttttttttttttttttttttttgagacagggtctcgctctgtcgcccaggctggagtgcactggtgcaatctcagctcactgcaacccctacctcctgggcttccacctcccagcttccacctctcaagtagctaggactacaggcacatgccaccatgcccagctaattgttctatttttttgtagagatgaggtttcaccatgttgcccaggctggtctcaaactcctgagctcaagcaatccacccgccttggtctcccaaagtgctaagattacagacgtgaaccaaggtgcccagcctactttaccattttaaagttgagagattgagttgtaactcgaccgaccagctgtattaaccacaccctccctcccttcttcgcattacaacacaatgaaacaacagaagcactcaatcagggagtaattctacaaaatgtatggcaagcctgagagaagctcaacttcccagtgttgggatccatctggatctcaattctccagcacacatttggttcttttcccaaggctctagagcctattctccggctttccttagaggctccttttctgaacagccccaaatcgctggctcatctgcctaccaaagactcgctaaaaacccatattacaagcaattcaaagcatgaaatgaaaattgatgctttcaactcctgtaacgatgaaaacgggaagctgccggaaactctatgctcctttattttccaagaatatagatagccttccaagaatatagatagtcagttttcaagaatagagatagcagcatgttatatgagataagaacttgctctaagggtgaagcattcctccctaaatttgaccccattaaggtggagcgtttgcattcaaaggcaagtctggtaggggtgtattaataacaaaaagaaaaaatgctaccttcagaatcaacactgaccaaagatgacaaactactccccatatgtaaaaggcacattaaaacaatgagtgactatgcccttcagtgtgaatcaaatcacatttttcaatctaggcaatgtagatgaaagtctcactactctaatggtgagatgggcagttcaaattctatctctgtgcaggttaagtatctgtaaaatgagaggattgaacagaaataacatctctgagttctcttgcaatattatgttctatagttctaggacttaaggaagtacaaagggcaatgtactgtctgtcattctctactaaaataaaagttccccaagggaaagaagtgttaattattgtacccttggtaccttgcagagtgcttggcatatacaacatgctcaataaatttttattgaacgaatgatgaatgatagtagagtcaggataagtttgcctggctccatcatttgattatcgggttccgtaattaagaaataaatatttatatacctaaattgtgacttcacaacagacgctaggaacacaaaaatgtatgagacactgaagttatccttaaacttatattctagatagtgaaacaagaaatgttagcttaagaagagaaccatctaggaagtaaagagttttctaatgttgttaggttcagagcagggataggtcagagtaaacagtttacagtatgcatggacggcttcctgcagtatgtggacagaaaactggggagacaggaaacttgaatagttgaaaatgatttaaaatgatggcaagaaggattcatttccttacaatggggcagtgaaataaggtgcttctatatttttatatattaacaagatactatgaaaacagattcaaacttaaacacgctgttttggacaatcacttaggccactcccaggcttatagatcccacactctgctggacagcccacttgcatgccccttgtgactttcccgtctactaagtcacccttcctaggaccatgcatgtcatcttggacctcttcctctcccttgcacttcctgctccagtattcaccaagtcctttctctccctaaatatttatttattgggtatctcccctgtcttccttgccttagcttgggctttttcactttgaccgtagcttccttgttgaccccccctgcattaacttcattccctaaatcaagggttgggaaattttttctgtcaagggtcagataataaatagaaaataggctttggaggctgtgtagtctctgtcacaactactcaacactcccaatgtggcataaaagcagccataaaaaaaaatacaataaccagatgaccaggttccagtaaaactttatttaccacgacatgcagtgggccaaatctgacctcaggaccctacttgaatgacccttgctttagatggttgccagggtggttttcaaaaaaaaaaaaacaaatagtaccatgtgactctcctaaactcttccaagacacccatcaccttcaggataagttccaggctccttggcatctctgtgtccatccccgagtctgtgtctcataactcttaaaattgcacactcaacgatccatgacttaatcccttcccagaaacaccagcctcttatgacttgatatacacatggttgcgtcctcttccaggaatgtcttcatttcctctgaaaaactcccatccagcctttaaaacgcatcaccagtgtctcctctactatgaaatcttccctgacctgaattctagacaaagtcaggtcagtctctgtgctcccccagcaccttgacatacttctcttacaacccatgtgacggtgggatgtcattggccatgtatgtgtctctcaccaccaccaattcccctgtgagggtaaagctattttgtacatctttgtatctttaacacccagcataatatcgggctcataaacatatttgggtcataacaactatttgtttgattaatcggtaaaaaaatcataaagatttcaacttggtactcctttgaccttgtataactgtaaagaaatctgaattcactcggtgctcttaactatcttggttgtgccaactattttaattcaacacttgctattaaaacttgtccaaatgtcagaataaactgttctttctgaggatgatataattcaaaatttccccttttaaaggagatgtactttaaaactgctacttagctgtcccccccattcgtctttaattagctgcttgaacaatgctgaatatattacatccttgcagagagctaagtcctcaagcaattagtctgtcctaccaaatgtgacctacatcactactgtgcccaggataggcaaaccttcacaggacaggataaattcctacatcttccagaatctagacagagcctctaaggccaaaggaaacatgaacttgcggtaaagactataaaaagtccatgttttttcacctatcaaaccagcaaaactttaagaaacaagagaatgaacacgcttacacatgctgatgagaatgtaaattatataattcttttagtggaacaatttgggagtttttcaaatcctaaaatgtgcattctctttaactcagtgatgccactctcaggagtttaacttacagaagaattcacaatacacacaaagctacgtgtgcaaggatgttcctttcatcaccgtttccatcattcaaaaactggggaatgttgggctaaatcatggtacagcaaaattttccatgaactccaccatctacaaccactgacttcttgagagtcctgactgtcaagctcactatgtccaaaatgaaactcctgatcttaaactaagagatgacccacccccgcctggtgtcccccatctagcaaatgactattctgtccttccagttgttcatgttaaaaagcaaaaaaccaaaacccttggagtcattctcaattcctctctttttctcacacccctcaggtcatccatcaggcatgagtctactctcaaaatatatataaccactttgtacacctccactaccattactctggtctggccactataatctcacaccaggattataacaacttcctgtcataacaacttcctgtcagtgctctctgcttccgctccttcggaaaacctcatcctactaccttcagtgaggctttgtgaatgttcattgggagcatgttactgcctggatcaagactctgcaatggctcctatttcattctgggtggcgtggttggttagggtctaaaatgtctagcataatctgtcattcttccttatactctgacctctcctcccatagttctaacccttgttcactctatttctgccactccggcctccttgctgttcctctgaaaatgcaggtaccacttctgccacagggcctttgcaatggattggcttttacccagttatgcacatggctccttccctcatgcattcaggtttgtgcttatatgttacttttccagtgaggtcgacccttgacaccttgaaaactctatttaaaaactgcaacatgcccaatctccacactcaacccccttactctgctctgctttttccctcgtataatgtcccaccttctaatatacgaaatgattcactcaactattacatgtactgttttgatttcacctgactagaacataaaccctataagggatcttcatctgttttggttgatcatatataccaggcaggcagaacacagttcctagcacataaagattgttaaataaatacttgttgaataaataaatatatcttagtgtttctgtgaggactaaatcagccagccctagcacatagcaacctaacaaaagtaggttccaattattattagaaagaataaagtaggcatgcatctactgacatggaaagttgcccagatgtaaagacaataagaaaagtcaagttgtaactgaatacaaagtgtgcaactgaactagcatgcaaaggggagttaatagagcattatcaataatactgaaaaactagaaacatgctaacaggtcaccatcagggcaagggttaaacatattataccatcttcccaccatacttggggacattatgtggttgtcaccaagaataaggtaggatatttgtgttacatattaagatgtcaatttcagatggggaaaagaaattgacttactgactgaacaggaggtagagtgtgatagcatcttctttgaaagaaaaaagaaaaaagctatgtgcatatatatattagtgcagaaaagttaggagggaaacaaaggaacacacgcacatgcagttacttttggagagttggacttcagaaagaatgagggctagtgtgtaattttatgctgcatttttccattgtgcttgacttttctgcaagcaacgaacccaacttttgttttgccaaccacagtaacttctgggaaaaacttcccatagtggaaagatctcattttaactaatcatttttaccttattccctattccctgatcttattagaagtaaattaagatgggttctaatacaagctacaggagggcagggggtttttatattttgttgatggggctatgattccccagtgcctaacaagcgcctaccacatagtaggcactcaaatattataagttattctcaatataaggtcaccttcaggtaaaattaaaagtagtaaattaaaaagtcccaagctagaaagggatatagcaaaagcatccataaactggagtgttaagcctcataaaaaggagtttaaatgtttacagacttttttggcttccctttcaggtcactatctataatcatgtatttttaaagcaactctctttggcatgactccacaattaatgagaaaattatagcacttactgtcttatagccaagttatttcatacagtctttgtcaaatttgtagattcccactgatctaatctttattgtggcaaagaaatatacccagtgcaataattcagatgcaaggactagtagattgtgaaggatgggggggaaaggagattctttaatcaggcgagcagtatgaacttttcagaacaattcaacagtgagcagagtagaaatctaaatgattttttacttccaatagaatataggataaactatctggttggtggaaaataatatgtatcattaaatacaaacaaacttatgtttcattttctattttcaaaatgatttttcaaggagttgtacttttttgcattgctttgataattacaatagcactctaggaaacagcctgaacttcataatgactgcataaggtcaaagttcttaatgtgtccattcattcaagtatttattgaacgtgtattacctgctaagcattgtgcttacgactagatatagaaatacgggaaacatattgatatctcattatatggatatagttatattgggatattgaaagagaaataatttaaaaatctccacaaacaaaagcctcacagaatggaattaaaagaaatatgtttttttcttttcctgccctttcaggtcagataatcatttaaaaatcttttcgctcaagaacattcagcctgatgagtcactttcaagcccaagacctcccctttactctcatgcctcagatcttctcaaacattttggtaaaagtcaggtaacattttctccatcctgtttttattcttgaatctggccacctatcaaaactttaaggatgtcaaccgccatggatgaagaaataataatcagcaacagcagctcaaggactgtatttgaaaaaacaaaaccaaaccagatatctagatggcatcagtcatcaactcactagattcttgaaaagcaagtggattgagtgccatttttatcaaatggaatcacttgtcaaacaggtttaccaataacaaaatggcaaatcccagatcccactatttagaaacattgtttagtcataattttcctgagtgttgacatcccaaattagtcatgtaaatttactgaaggccaacagtagcagaaacttgtcaacaagaccgaggaagcaaaggaaggcagcatctttacatttttagtgtttataacacttcaaaagcctaaaagtcatcaacagctggcctactatcagacacagagatcagcagagttactgaattaatggctggcattgttgctttcttcccaccagacatctcaaaaaatgctatgacagtttttctggtgccagagggtgtcagtatgactgcgagggatgtgcttacattcaaatatttggggtctgattatcaacataagaaatttttttttcaaaggaaaaaacaaacatgctgagaaaatggtgattactaaatgaacagaattttgttatgcaaatacagttgcaaagaaaaagaaatatctgcagtattctgatgggggggtgtcttttgatttagctttttctagtactatcaactctatatttactttcagctttagaaacccttttaccttcagtgctcagtgtctcccaaattctattccatgcaagcctaataagccaacatcagaataatgcatgggtctgtgtatttatttattgaaatcattaaacaggcagtttcagtcggtatcacatcacctgctttatattacgcagcacagggtcaaagagaaattacaattaaatttttcaataactggtgtcaattaagcacggtgtttagctcctttgtaaatatggagatcttattctctctgtcttctttttccactcctctacccccatccatatgccaagaatgaatagaaaacaaggggaaaggagaggctgcctcatcagaagcctttgctagatgtgtcttagtaaaatcagctatagtcattacttctatggcaccattaattcatgggcatagtttctgttcttatacacaagaatgtcaaagatccatacaactgtttatcacaaaaacagtcttgggtatcaaacgtataggttcaaagagctcctttctgttaataaagcccatgtgaaactgttttgccacaagcttttagagaatctagactcagggttggtagttccagtggacacaccaggggccacctcacaaattgcctcttctggccacagttaaactgaagaggcagtgaggctctagtctcccctgggggtggtttcatatcaaacacacatgcccatgcttttgctcagcaaggatcgggagaggagcctcaagtctaatcataggaacagaccgatttaagagccataattgagtaaaaagaataacggaccgattccacgtctctctagcacaaacacaacaaatccaaacaccaaacctcaagcatctttttaaacacagaaatacaacttgaaatatacagcctaagaaagaaactacatggggaagcaaatgggtaagcttccgtttttaactctctggggtgggtagggtgggtagggtgggggtggggagttaggagtatcctcatcaagaatcctttccctctgccccatcccctttcccaaagccaaaagaggaaaggcattgagagacaggggcagactgcttctgtttgctcagttgagaaatggaggaatcgagtctctgttgataccattaaactgctaaagctttcaacagcactaaaattcattggcaagtgatgagctgcgccttgtcgacgagtttcagtgcaagttaaatcacgaaaagaatccaacttcatatctaattaatacaggcttccaagtgatcaaaaaacaacagtttttcagaaagtatgagccttatagatgataaaagacaagcttttctcaactaagaaatgcatttattttcccagaaccccaaagacagtatgtcattccgtgggttaccatgtgcatatggaatttttatgttttcaatataaaagtcacaatgccctcatgcaaaagcttcccgttttactgaaacccccaacaaatgtgtccgaatcttttgaaagcactgaatactcattcaagaggagtagtaaaacaaacaacactataaaccagcaagggttatttggctagcacacactcataagtagtctcctaattgattctcagttgacagggtgttgagcatggtaaactctgggaaagagaaaagggcccaacatacctaatccttaaaaataagccatacataccctcaaataatttagttcaggcacaaatccactccctttgtgtgtgagacaaagtctatataccaacactgtggacaagacagcttccttgtacactccattgccccctggtacccaggtcagttagacttaggacttaggaagaggaagggaggcatagccttcctgaatcttcaaaaatcccccagccttccgggtttggcccattcacttacagaaccagacagggagaaaagccttttagctcccaagcactcagcaagccagactctggattctgttttctgatgcccacagacatacatctcttacctagataacacagtgctctaacatacaaatgttaatttccaggaagcaaacttaaaaagccttccgcatgtacattcttccttttagaaataggaaaacggacagaggagaatcgcagcccttccgtttctaattttccccgagagcttacaaagccctccaaagtgcaaaggcatttgcccaccgcgctgcccggggaagcagctctccctctcccctgccttccccagcctgggcgccggaacaatgcagcaacatacatttaccaacacctgctggagcctattaatatgcacggggacgtactgatttttcccccctcccttcccctgccctccacactgagcaggctttcatctcctcctttaccatccatcaggaactcatttcgccggccccctccccctcccacccccagtccccattcagccgagcccctcgctccaaaagcccgggctgacgagcacactttggaatgcacttcattaaaatttagctgcccgattccaacctgcaatgcggaggaggcaatacaaagcgcgcgccacacttcctccagcatccccttcaaaagccccattgttcgccaggcatctgctccagagcccggcctctccctatccactgacctctgatttttttttctcccccctcccccttcctcccagcctggccaaacgggcctgcctggtgaattaaaacgcagccgcagccatctggccctcccaagctggccgggtttctccccgcccctcctccctggtccacacaccacacacggcatcttcacctccatggatattcccacaacccaagctcaaacctccggtggcagggagcctctgccgccgcctgcctgtccccaggcttcctccggcagcggagcgttcgaatccagaggtgggcagggggcggtggaggggtggcgagaggagatcatggaccacttgtacttgcctgcaaaccccagcccaatcgccaagattaatccttccctttgtgagcctgaaaccgcctcccaccacgctggtccttggctctgcagcggctgtaaagagaggcgggggtggggggggggtgggaccgaaccccttcctgggagagctgggggcgcctcggccacctgaccacagagcggtttttcgagggaagaggtgctggcagcaggagcagctgatggtgcgagaagggagagaagatgcccaggcttgcgccttttatattactggcgacatttctaacacatgacaacaatttccatctgtatttaagccgggagtgtgaaaaaagagcattacatcacagagcccgggctcctagaggctgccggatatctaggccggggggattagggggctgcacctgcggagggggcggggactgagcgagcctctccctgctggggcgtgtcaggtccccatcacccgcatggccctgtgggagcccctggacatggaaaggcgggaaatagggttgccccatttgcgacatgctggaggctgagtgcatgagtgggtgggtgagggcgagggaaggggcgtgactccctttcttggttagggatacaaccctgacttcccaagagcaagggacagaagtcccttctgatgaaactgacttctgcctttctgcctcttccccaactttggaaggaattccaatagataataactcttatgtttgaaataattgtcttcctttggagttaaaataaagacgatggagtggcttagaaaatgaatttgaaggatccactttcaaggaattgacacttcaagaatcaaaggtacaatctgactcagaatcaagctgcttctctactgctcacctctatgtcattaaaactcactgtttttaaggagtgataggatagtggatagggggaggctggcctctggtgcagatggttggcaaagctgcctctttaaaagattctctaagagccggcggtatcacctccaccctgtttcttttgagggatccttcctcttcatccaccttagtgagaaaactttattgagagacctctagctttggaaaggtaagttttctctattttcaaatggtcagtcattgctgaagctacaccttgtagcaagagagtgaatgcctccagactgtcaaagaaaggacgctatccactgccttccttctcataatccaggtgctacagagtcacgtgcaagcatcctccaagaattcattactacaacttggacaggaggagataaaggggctgcaagatgttctgagaggaagaatgccaagaaaatagggcaagaggggaaaggaagcaagggcatacctctttctggggtatgttgggggaggcaatgcagaagctagattacaaatgggtggatcataggatggcaaagcaggctttacgggtgcgggagaaaggtgagagggcagtgggccatttagataacaaggcagcacagatctttccttcgaatgcagtatcggctggatttcatagcagatgagaaaataaatgttgttccttcatatttgctactcagtaaacctaggcatgtccatctgaaaaatccagggtgtggaaggacagcatgtctaaggccccttttccttctagtcactcactgtggtcaaaagactcaatactggagtcagactcactaggttccaactccatctttccattttccagctgtgtgactgtagataattacttgcctgtttcccctggtgtacaaaatggaacaaaaactctctacttgttatacagatcacacatacaaagtgcttggtacagttcaccatacataacaggtgctcactaaatgtcacctatcactactgctactattatgattgtttctatataaaacatctcaaccaaatgaaagtgttcatcttctactactgaggggacctgcaaaatggaacagctcccagggcttcaattagtgaaatgcaaacaccagaaccctagacatcctggacctgccagaaaaaagcgagtaagatgtctcggaagaaacacagattcgctggcttcattcttgattcacatctacttgcaggaaggtgaaaggccttaagagttacatgcaaagtatttgcttacctattttgtttgagagaaacaataaacttaagggaatactttatcaaccatgtacataatacatacgagcatttacatcacttttcctctcaatcattatttttaaaaatggaaaaagaaaagcagatactacataaaactttcaaaagccttttgccacaagctaatgctgaaaaatggaatttgtattttattagttttccacaagaaaatgattgtacagtacaaattaaattgctcttttgcaaggaatctgcatagagacttccctgaagggaacaaaaatacaaaaggcattctttttatgagagaaagaagggaacttttattcaataagtattcaaggatgtagctttccagtcttcaatagggaaagaaaaatagccgtcattttggttaggaaatatccctaataataacaaattattttcaatcagagctccaaagaccaggtttctctatgtgcaagagaagcacaggaaaaagagtccatgaaaatctacttggtttttctcagaggtgtagtatcttgacacactcaatctcaaaaaccaaggctctcccagcttgtgtggtctccagcagaagccaggagagatgcttagttgcatttcttttaaagtctcttttgtcgcacacacaaaattaaaaccagtaggtcctgggctagccagcttcatgggcgcctggcttatagagccaagggcaagctatggctgcagtgccttgagagcacagtttagagaggcagtgaaatgtagacacttctttactggcaatttttgagaaataactgtgagaaaaaggccaagagtttctctcactgaacacattgaaagtaattagagaaatgtttaggaatcacaataaatgctgtggaaaagtgaccacttgcgaggcagtagaacatactggttatgagagtgggatctggggctagaccagttcaaaaccccacctctggctttctcagtgtgaaccactgggcaaacttgaccttacaatgactctactttttcacctgtaaaatgagagtaaaaggagttcctgcctcatggaactgtgatgaagactaactgggtgaatagagggcatggtacttagatctgagttcccggcacagagaaagtgctgactaagtattattactggcacatcaacacgctaactcttaggtgtggattccctctaaatgcttgctctgcatatgtttttccacaaatatttattgagcacataccaagcatatagctctgttggatataataaagaggcagaatatatccatggggtcagaaaggggttttatagtttgtttgtttttttaatagaaatgtcctttggataaaatatgaactcacataacacaggccacattcactgactaaaatgtagtaagaacagccattaacagtcaaagggaaagcaaaaattcataataaaatctgcaggatgtacccatatgcccacacagaaggaaattatagccttaaatgcatttattagagaataagagagacagaaattaattatgctttctatgcatgatgctgtaaaagttaaaatgaaataaattaaaaaacaaaagtagaaaattcaacagtgttgggacaactggatatccacatgcaaaagaatgaagttggacccccacctccacaccaaacacaaagattaattcaaaatgcaccatggacctaaaattataaaactcttttaagagtaagataaaaaagcagtaaatcttttttatcctgggtgacaccaaaagcacaaataaaaaaaaaacagaaattagacagattagagtgtattaaaatttaaaacttttgtgctgaaaacaatatcaccaagttagtgaaaagacacccatggaaagaaaaaaaatactggtgaagcatttatctgataaggtccttgtatccagaatatgtgaaaaacttctacaactaaacaataaaaagacaaataatccaattaaaaataggcaaaggaattcaataggcatttctccaaagacaatacacagatggccaacaagcatatgggaagatgctcaacaaatcaaaaccacaatgacatcccattcatacccactaaaatggctataatcaaaaggacaagtaagtaacgatgttgataattggaagtgtcctgtatgctaatataaaatggtttagccactttggaaaacagtctggcagtttctcaaaaagttaaatttatgatatgaccaaatgattccctcagtatacagccaagagaaataaaaacatacatccacataaaaacatatacatgaatgttatagcagcattattactcataatagccaaaaagtgaaataattcaaatgttcactaactgatgaatgaataaaatgtggcacacccatatgagaggatactattgggcaataaaaaggaatgaaatactgatacgacatggataaacctgaaaacatcacgctgagtaaaagaagacacaacatgtcacatattgtgttattccatttatatgaaatctacaccataggtgaatgtatagagacagaaggtaaatcagaagttacctatagctgtgggagttagaaggaaatgggatgtgactattaatgcatatagggtttctttctcggggtgataaaaacattctataattttgtggtgacagttgtacaccttgagaataaactaaaaaataatgatttttaaaaataggtcaattatgtagtatgggaactatatttcaataaaactatttttaaaaggtagaaagaagaaataatgaaattaaggtagaaatttatactggacactattggcaataaggaaaaaatagagacaaaaactgtttctagggaagcactattaaaatagaaaaacctttggcaaataggaccatgagtggggaaaggagaaatcatatatgatcaaccttaggagcaaaaaaggaggcaatacaaatattaaaaagatttattttcatgtataagagaataccatgtacaactttataccaattaatttaaaatctagacagaatggttcattttctagaataataaattaatgaaactatcttaagaagcaatagaaaatgtgaatagagcaatgactgtaactaaaatgaagttaaagaactatctcctccttcccttttcctagctactgcaaagaaaaaaatacgtaccaggccaggatattttatggacagattttaccaagctttcaaagaaaagtgtgataccctttatacaactccaaacacaaatactttccatactgtttattatatattttctacaggttcatacatattaagaataattagaaaaagatctcagatgaatatttaaaaaatgataatctatgattaacagaccaaaaaatatatatagcacagtgttgagatggtcaaaggggacaatgaaattcacgatgctgcttccattttgaataaaaaaatttatatgacaatctacataataaaaatttgacaattatttggaataaaaaattaaggtattatttggaaacatgcattaaattttctgtctagttgattgaaccatagaacgtagataaaagggaggcattactgccatcgaacagaaagttattctaattgtaggtaaaatccctaagaaactgaaaagcctacatgctggtcttgtaagcctgaatataaagttaaagcagaactaacaaaaaggaatagccttgtctttctttgtgttgctataagaaaatacctgagacagtcgtttataaagaacagaaatgtatcatagttctggaggcagggaattccaagatccaagtgctggcaagtttgtcttttgagggcctggtctctccttccaagatggcgccctgttacagcatcccccagaagggtaatgatgggtcctcacatgacagaagactggaagaaaggaaacccactctctcaagtctgtttaaaaggatcctattcccatccatgaaggttccaccctcatgactgaatcacctcggaaaggccccatctcttactacatattggccattatgtttcaacacgtgaattttgggtgatacattcacattatagcactttgtaattttcacaatatcaaaatttccttagttctaagatgtaattaattataagattcaactttcaatttatggcttttcaggggaaaagaaaactacggcattaaatatgcacatttatgtttaaaaacatccaaatgcaaaaaaaaaaagtatctgaggatcaagaaatattggtgttatatgacaaagaagacactaataaaaatgaaaaacactcttccaatgataacatttgaagctatgttggattctacagcaaagttgtgcctggataatgatgtttagttatatattgatattaatatataatgattatttaagaaatagcaaatactgctggagaaaggcaagcaaaacaaaagtgcctcaatttatctgatgctttttaaattggccaagggcctaaaaataataacagagaaacgatatcagagttgctactgtggatgtttttcctggcttgtggaatacgatgactttcatataatgtcagagacaaataataaatcacttcacagttatttatatattcatagagatgggggttttccttataagaacctttgatttccatcatataagaaaaaagaaaccaaaaacaccaacttgaaatgctattttcctactggattttaacttgaattgccacaaatgtgtgaagaagtgaactgcttatttaaaaaaaaaaaaaactattgacaagtctctggcttttattagtcaactggaaaatcaaacagcaaatggggaataaacaaaattcctatgactgtaaatttcaacaagaagtgaaaatagaacagatgtggaacattttccttaatgtgttactatttagcagtacttccctccaaggtgcaaaacatgaccatcttcttggaatgtactcaaatgggctcttttacaggctttccaagaaaacacaaaagcagcaagcttccagttgttatgcctgaaaatgactcatgccatgaaaatatgcaacttaagatagctaatgagagaagaaccattctacgacagctctaacaaagataaagttccagaaacttcaaacatttattgtacaagggatgtcataacgaccctttcaatttgcatgacgagacctcactataaatgacctgttttacaagaccacatccacttatccttaaaattgcacaatttacaatgaacctgtgctggtatcatccttttgtattttgtgttgtgactcttgctggcttcagaacacaaattatggctctcagcatcatgttcaccatgtgcatctttgaaaaatttcacctgtgaaactttacactacactcacataccagccaaatgagttcctgaaaaaatctgccacagtgaataaataaaggggggagaaattatagatttgatacttgctggggagtatgatatgaaagtaattgtgcttcctgtaggccatgcacaactgtaagaagtgctcttcttcctgcagacagacaaactcaatgatggagagcctaacagttggcaataaaagaaaaaccagcccttgtaggccaaccagacccttctagagtgtctgacctacttttaaagcatgctgaagggctttcagcagataagagttaatgaaggagagagaaaaaataagtctacaatatcacacttactatttaagtgtgcccatcagtgtgccttatattagtaaagtatacattgtccaactcaggttcaatggtagattacttatataggaaacatatctcaattgcaactgctctaggaaacatcaaatattttgacgaaagaattacagaatcaaactctgaaatgaaagtccacttctacccacaacccagagaggagatccggcgagtcctactttgtgcagggtagttacatgtaaaacatcccttccctcctcctttgcatccattcaactctgcctactaaatgattatttcaattagcacagaatgtgcatttctactcatcagatacatggacatatttttgcagtttgagcacctactatgtgccagagcctctcttggtgcttttcatgtattatgttaattaactctccctacaagtctatggggataatactattgtcccaattttataaattgcaaaacctcgggtaggaacttatccaagatcacaaagccagaggacagaagggctatgagtcaaacacgtatctttccacatccaaaacctatgtttactcagcaaccactgcaccgtgcctctcagtgccctgaaggttattttacttttactttctttatttttttattttgtttatttatttatttttttgagacaggatcttgctctgtcacccaggcaggagtacagtggcacaatcttggctcactgcaacctgtgcctcccaggctcaagcaatcctcccaccttagcccccagagtagctgcgattacaggtgtatgccaccacacccggatgtttatttatttatttgtttgtttatttttgagatcgaatcttgctctgtcacccagactggagtatagtggcatgatctttgctcactgcaacctccacctcccaggctcaagtgactctcctgcttaggcctcctgagtagctggaattacaggcacccacaaccacgcctggctaatttttgtattttcagtagagatggggtttcaccatgttggctaggcaggtctcgaactcctgaccttaagtgatccacccgcctcagcctcccaaagtgctgggatgacaggtgtgagccgccgcacccagcccggctaatttttgtattttttgtagagatgggttttcaccatgttgcttaggctggtctcaaactcctgagctcaatcaatccacccaccctggcctcccagagtgctgggattatgggtgtgagccaccactcctgacctaagactgcttttcctgacaattctcttgaaacccagatactggtcaacactgatatgggtttttaaagcaagctccaataactgcctaagtccctatgattttttttccgattctgacattttctatatattttgaaaatatatgtacatgttaaataaataacaataacataattcactgtaatatggtttgggatgcccaggtaatccccaacactcatgaatctagtgtgcagatggacatccaagaatagtgcctccctgtcaaatagctggtacctaccccagtctcttgcagagaagaaaattcttttctcctgactttccccttcctgctacaggtcacaccactccctgaaactgctattgtatatgcccctgaagcaactttccaacaggcaacagtaaaggcaggcaatgcttctgttaacagaagtggtatcttcatcaccttcaacatcatcctcactcccatcatgaccattacacatcacagcagcccccattatataaagtgcttacaggagtccaagcactgttctaggcctcacaacaaccctttaaaataggcattgttatctttgctttgcaaatgaaaaaaaactgagtctctgagaaactgacaagggagtgagaggaaataaaacacaaagctcactgactattcttatgtgctccctactactaccctggacaagtaaatttctttaattgagtcctatgtctatattttatcttattctctctttttggaaactcacttctggtcctcatttgttcccatcacaagaaaaatttcttaggagaattgatatgacctcaagtgttcctttgaacaaatcaggtgtttcggcttactgcgtattatgcatgcggccactgtctttccttttgtactacaactataaaaaagagaatagcacataagaaaagagaagaaaaaaatgtcagaataacttaatgaactgttcacctaatttaagaataggtttaaaaaaatgttttaatactacttaatcctcgtgtgattctcaccacaacctacaaagcaggtatcattagccccattccatagaagcagctcaaaaaggttagacaaccagtgcaagcacagccaataagcaatagaatcaaaatttaaaacccagttttttctacaaatcagaaagcaaatgacaatccgattaaaaagacaaacggggaccgggtggagtggctcatgcctgcaatcccagcactttgggagggtgagacaggcggatcacctgaggtcaggagtttgagaccaacctggctaacatggtgaaacccagtctgtactaaaaatacaaaattagccaggcatggtggcaggtgcctgtaatcccagctactagggaggctaaggcaggagaatcagccaggaggcaaaggttgcagtaagccgagattgcgccattgcactccagcctgggcaacaagagtgaaactccatctcaaaaaaaaacaaaaacaaaaaacggacaaatggaaaaagacttgaataaaaacttcatgaaagaggatatccaaatagacaatgagcatttgaaaaagtgttcagtatcattctacatcagaaaaatgcaaattaagatcacaatgagataccactgcacatccaccaagatatgcaaaaatttaaaagactcataataccaaatgttggtgaggatgagaagcaactggaactcttacacggtgtaggtgtgagtgcaaattggtataactactttggaaactatttggcaatatttattacagcagaacatatgacgacactgtaatccagcaattctactcctagaattgtgcacatatgtccattgtataagaatgctcacaacagtagctaaaaactggaaacaaatcaacagaagaatgggtaagcagatcatggtatattcatacaatcaaagactacacagcaattaaaaaaatcaaactactgctacattcaaactacatggatgaatctcagagagtaatgttagcaaacaaagttacagcagaagaatacatactttatcattccatttatatgaaattcaaagacaggcaaaaataatccagggtgatagcatcagaatcgtggttacttttgggaaggaagggaagcgttcaataagaggagacacaagggagctgctgaaaacctcagtgttcaaaatattgacctgggaaatggttatatggatgagtgtgcgtggtgcatgtgtgtgcgtaaaaatttaccaaaccatgcagttaagatttttataacttgctatatttatttcatctctatctctctctctctcttttttttgttttttttttgagatggagtcttgctctgtcacccacgctggaatgcagtggcctgatgttgactcactgcaacctctgcctcccaggttcaagcagttctcctgcctcagcctcccaactagctgggactacaggtacgtgccaccatgcccaattaattttttgtatttttaggagagatggggttttaccatgttggtcaggcttgtcttgaactcccgacctcaagcaatccacctgcctcagcctcccaaagtgctaggattacaggtacgagccaccgggttttttttgttttttgtttttgtttttttttgagaaaaggtctggctctgttgcccaccctgaagtgcagtggcatgctcatagttcactgcagcctcgacctcctagactcaggtgatcctcccacctcagcctattgaattgctagaactgcaggtgtgcaccaccatacctgggtaattttttgtagagatggggtctcccaatgttgcccaggctggtctcaaactcctgggctcaaatgatctgctcatcttggcttcccaaagtgttgggattataggcttgagccatcacgccctgcttccttcagtttttttaaagggtctctgttagaacccgcatatgactagcacaagcaattgttcacaatcgttgcattctactgccagaatctggaataagagaaagaaactttgatgtgcccggacaggccagacccttaagtatataatacaaattcagaacaaaacagcaattattatatcaacaacattttttttttacctactccatgttccttagatatctaactgtttcttgatttataaatgatccactcaacagtaagctaagaagttacaaaattcccctacagcatccttgactcaagtggattggaatggggtatctaattctgaagcaatgcaagacactgaatgcccacctttcaatagctcgcctctgggagaactagaattgaacatcaaacaaaaaagttaatgaaacctgtattagccacaaacttctatccactggggaaaaagccatctagattcccagaattagctagggtcaggcaggcaacactgatagaattcgaacagaatttcagtccacctgatgatttcacatgatgtcttatttccaagtcatattatacatttaaagaacactttacctacaactcaggcagctattttttttcaaaattccactgaaacagatatatctttttttttcccaagtcactaattaagtgaacttgagactgtgtaaagccatttcgagatggaaataaggaatatgtatccctcaagtcaattgatgaaatctaagaatacagaaactgcaactccaataattctataaggtctgtttgtaatcttatcctatgagacgggaaaggagaaaaacgtcaggttcatttaggtacaaatatagtatatagtatatatacagtatatatatagcatatatatatactgtatatagtatatatagtatatataggtatatatagtatatagtatatatacagtagatagtatatactatatagtacatatacactatatagtagatagtaatatagtagatagtatatactatatagtatatagacactatatagtagatagtatatatagtagatagtatatactatatagtatatagacactatatagtagatagtatatatactatatacatatatacatacatatagtgtgtatatagtatatatactatatacatatatacatacatatagtgtatagtatatgtactatatacatatataatatatagtatattatatacgtatataatatatagtataaatagtatatagtatatatacagtattccatctatgctgtatatacacatatggtatatatgtgtgtatacacacgtgtagtactatatactatagtatatactatatatactatatacatatatagtatatatactataaatagtatagtatactatgtgtatatactatatgtacatatatgtacactatatactatacatatactatatagagtatactatatacagtatatatacatatatacagaacactgtatactgtatatacatatatagtatgtatgtatactgtatatacagtatatatagtatactgtttatactgtatatatactatacatacacacatgtatacacacacatatactatatatgtacatacagcagatagaatactctatatatactatatactgtatatacacatatatgacactatatatactatactagtatatacagtatatatatactatactagtatatacagtatatatatatactagtattatatatactatactattatagtatactatatatagtgtcatacatgtgtatatacagtatatagtatatgtttatatactgtatgtgtatacatacatagtatatatacacatatatagtcggaggaaagaaacagtggtggttattagtgggggttcttgtaaccaacctgactgagctgcagtcctattcgataattgtaagccaagccacttaactttattagcctcagtttcctcatcagtgaagatactaatagtaattacttcctttataagatttctacaagtattcaataggaaactataatgaaaacacttagcataaacttggtattctgtaagtgctagattcttgttttaatatgtgcacaatatctttcaggctagtctctctatactttaatgaacacgatctatcaacatagtaacaaaatctcaattctagactaaaaacactgatataagtaagggggaagagagacaaaaacataacattcacatataatcccctttctcccaaactataattgtttgattattttttattttttggtataggttgattttccttttatagaaaatatcaaatttacagaacagtgcaagaataagaatagtacaaataacaccatacacactttactcaggcttgctggttactaacgttttaacctaccagcttgtcatttgtcctctctctccctcctcccacacataatatatttgtaaccatttttaatgttttgtagccatttgagcataagttgcatcattcaccatggccatttacccctaaatacattagcatgtatttcctaaaaataatgatgtgttattggttaattttaaatgcaataaaaaaatatgtcattgatcattttaaaagtctactttattcatattgtagtgaaaataacacaattgacgttttcttgtttaaattttgggcagctcattccccaacacaaactaggtagggcaatcagaacacaattggtgaaatttccttacttggaccacagaagaaatacacacaatccactatagaagccagaaattttacttacgtttattgaacacatttgatacaaggaaattttttaaaatatattatttctcattctcttgactcaaatgattcttgggaaactaaaatatcctttcctcaaaataaataatacatggtaaggatactgtgaaaactttcatgtgccttcataaatcgtcatggaaattgctttataattgcaacaaatcttgatggaaaatgtcagctaaaattataaagcaattaaataaattaacatgactgccaaatagatatattagtatcctacactcagccaaatactaatccatatgttattaggaggagactcttttttaaaatttaatatgttaatttttaaaaatggtctttaaggtgattgcaggcagaaaaataaaccaagagcttggactgtggaggtggttagaactaggtttgaatctgagttccatcattatttaactgtgcctccctggagatgccactacctaagctctccacacctcaaatgctgcactcatactacagaatacagaatacaggactgataacactatgccctacagggttcagagatggctaacacagcttgtaaatcacttagcacagtgcctggtgcatacagtaagtgctcaattaatgacagatgttattattaagtggtgaggtctgatctaacatgttttcacaagaagattataaattaccacaactctaattaaatttaatctaaaactcccatggctttcccttttctacatccctgagaaccttacaataaagaacaccagccaaaccatgtttatttgaatctattaacagacacatataaatcaagtccagtgttatgagcttttacgtttgtaatttttttcccattttttctccaataggactctatccactcagcaactatacaatggcaattagggttaacaacgtataataagaaatacaaagaaacagaacattggggaattagctgatgctgggaaaaggcaaaaaatgtgctgtttcaagcatgcctattattggctaaatcatccaattattaatcttcactatattcttgcctggcatctagtgttgggttgttactcaacaaatgccggaaagtcagttttttaaaacttagcttgtttaaagaaaaaaaagaatcttcatataaataaggcctcaaagcctaaagagaaactgaaaagagtgtttgggaagtcatgctagaaagggaagggaaaggggtaaggaagaaggatcagtcttaacagagggcctacaaagtatcaagctcatggctgggtgcgtccatacttcttctaaacatcagtaaagataatgaggaaactgagtcacaggaagcatgagtaacctgcccaagccaacaaaactggtaagtggtagaacctgccagcctctcaggtccaccacacctgaaagcccatcacatctgaatgttctagactcaacaagacaagcgctaatgacacacaggggcagggcatgagtccaagtgtactatgctgaatgggccctgaaaggtggcctgaaggtgctggaagggcctttccagtggttctcttttccattacatacgccattgtgctaaagtaaactaatagtacaaatggctgtaaaatgcagtggtttaagataataactttggggtctatcagactgaaatcaaactcagctctgtaagtgtatgcacttgagcctctataaatctaattttcttcattggaaaatggatataataatagcttatacttcaaaagattaagaggataaaaggaaataatgtaagtaatgtgtttaacagagttcctgacacattgggcatactcaataaacacaacttggtttttttaaaaaaaggtatcaatttttaaattagaaagcatggtatcagataagttactcagcctctctgctccccctttacctcatatgtaatgacagtaataactaccactagcatcatggtacaactaaccaaacaatatttgtaaagtacgtaggctctttactgacaaagagtgatgaatgccagctgccctgtctagtgcagaatttagaatttcagagccgatctaaaagctttaaaaaaaatggctctagataagctgtaaggagaaggactgataaaatacataagatcaaaaacagaaataaaaaagacccaggcatggtggcatgtgtctgtagtcccagctactctggaggctgaggtgggaggatcacttgagcccaggagttggatgctgcactgagctatgatcatgccactgtaccccagcctgggagacagagtgagactgtgtctccaaaaaaaaaaaaagaaagaaagaaagaaggaaagagaaaaaccaagcaagaaaaaggtaagtaaggtggagtatcaatagaagtaactgacatggactagcataaacaaagccttgtaataaatggcataatccacccatcacaatgtcagttttattgctgacaaaagctacaatggagaaaatggctttagatctttgttaacaaggggactgttaataaatcacccccaaaattacacttaccaaacccattccccagcaaatctcaaaaccactgtcttccccgtgagacccacccaaagatttccagcagggatggacagtgaatgcacgcttccctgggatcagacagagtccccaagagaagaggaattgtcacggtcaggaatgtccaggtccttctcataaactcactaacaggaaaactcacttctcccctagcaagaggtaaatatagattccacacttcaatgctcctgaaggggcactgtagaaatgcaaagtggttttctgctgagttgtcacaaatatgggggatgctgctggcatttatgaggagggttccagggatgctccaagttcctcaatgaataaaactccagaataacaaagaaccttcccgcttccctcaccaccttccagtgctccatcggagagtcccatggataaaaatgtgtttacacttatctgagcccatactctaagctccaaatcacatctaaacaaaaagtattgttatctaatcccatgattttttaatttggcacaaaactccttgcctggactattaccttacttcgcgaaacataaatcatagctcaccttatacatggtgaaataggaaaccacgtacaagcagtgcagtgatatccttgacacagtaacgcccttgacatgggcaatcttgtgtttaaagtgatttctatgtacacagtttgtgctaaacattatgaggagtacaaaaacaaatcaaaagcctaagaattcgttgctagccatgaaagtcctctgttggaacatcctcttacacaggataatttggacagaaccacatttaaagtcacaaatatatgatggacaagggaacctcataccacaataagaaacattcacttctttgttctaatgcttgtcttcttaaaggaagcccactagcaaaccgatgcatagcaaatacgtttcaatggagaaggacaggtgtaagcaggcaaggggtgggtcagtaggtgggaggagtccccgtatcacagacaagccaagggcacatgggaaaatacagtcatgatgggtagaagagaaggggagaaaaagagtagaaagctgatcaagataaatgttgtttacattatacgcaacaaacatctgtggttaaatagaaaagagatagagtcgaagcgttcagatccttaagagttgtactttagatgaagccaaagttagagatgacatgatagagaaagagaaagggatagagagagatatcatgacagaggatccggtacacagtaggtacccaaaagctggagagctattgctattgttactagtcatagttttgccacaggctaggctttgtaaaggctaaagcaatccttttagacagcccttagtttagatagaggacaagggcagagaaacagcaatagagagaaagtttccagtgacctttatctctttatctgatcagtcctatgatgcttgcagaactctcaagttcatgagttatgaccggaagcattccaccagtgtccaacacaacctgaacacaggtatgcacattccaggagacaaactattttccaacatccagttctttatcctggacacttgctgacaaataggtctagttcatgttatcagctctaattgtcaaagatcacaggaaaagtggttgattttaggcaagccatcctggaaacaactatgtttaagagaaaactgtaagttcaaatagaactaatggtaatttatggtcccatttaaaataataggcaatgatagcagatgctaaaatgcccttttgaatatggctatcttataaagaccagtatcacctatgtttaccacatcaaatttaaattgccttgtagatcaaacacatgtaatccctccgtaaagtcctttaagtcaatgatcaatacctcttagactggttacaatggtctcagtattgggaagagccttgatgaacaaagtgttaagctgcagaacaaaactgacttatcctttcctcttttaggtgacctttgcttgaaaagaaagatgacagttgagtccagaaaagtgaggaggaatgggaggggcattgtacagcattccagagaaccagaactactggatgagttgtatctcgttttgacagcagcagtatagtaaatgacaagccctgtcaggtaatgcatttatcttcatgggaaaagcggccattccaaagcaagaatctcagatgttgtcacatcagctaggacaagaagtcataaaacaagaaggctatcaatgcaggaggtacggtgatatctagactacaattaagaggagctgtgaacgggcactccagctccaagctcatgggagctttgacatttttcttgtgtgcttcgagtaccagccaagtaattagtgaagtccttatcagtcatctatgaccctttttggggctcaagactctgaccttccttatattctgaaagcgttatggtcaaagcaattctgctgtttttctcaaatgttaagtaaggaagaaaaaaataaaagaagaaaaagaaagaatatctttttccatttcttcatttgttcatgcgttcaacaaatacttatcctatagtccaggcactaagctaggagtggcctggtcactcagttagatacgctgcctgactcatgaaagttagaatctaattaggacaggcaggcatgcagcaggcactacaatcaggcacaaaacaggcatgaaggaggtcacggagtgcagcttggggagtagggggagagggcaacaggcccaatctgcagaagcaacggaggacttcgtggaggaagtggcatctggctaaaacttaaaaagaagactgtgaactggtcagatagataggcagcgaaataggaaaaaataatatgtactcatttataagaagacacaaagtgtgtttggaatatgaagtttgtagggttgaagcgcagagtgggaggggttgggaatgtgaccaaaactggaggaggagaaagagaaatattagccagatggttctgaggaatgagagaagtaggcatgtttacaagcattgcaaaggttttccataggtacacaaagaaaagatctaatggaaaataagataaacttagatatgctaagaaaatcatgtaatgatttttttgaatctgaataatcattattaaaattatattgtacaaccagtgaattacttgaacatcagagagaatatacttatttttaaggtattgtgccttccattgcttccaaacccaccagataaaacgtcattattttaagcaactagagctctaaattcagccatcagaaacttttttttttcttttactctcaatagtctgtttgtatattactctaatcaggctattactaataacacccaacttgagagttacaaagaattggtttaaccctgacaatgctacttgctgtgtgaccttaagcaaactattaacctctcttgagcctctgtttcctttaataagactcaccttataggattgctatgtgtatctgataagacagtggttgagtcagtactactatttccattttactgaagggtcaacgagattcagagaggttatgtgacttgtgccaggccacacagccagcagagtagccctcagacttcacaacaggcccctgaactcattctgcatctgcatctcttttctgttggggtttttctagtggtattttgaatggtaaatataattaaatttcaactaacatgccctttcttcttactgtagaaataataaaagttcttgaataaagggaagataaaaggggagtggagaataataataactgtaacaaaaatagcactggatgaacactttaaacaggtaagttgtatggtatgtgaattatatttcaacaacgccgttacaaattttaaaaagtaaaatagcagcagatgaggaatgagtaatatggcatttcaaatggtacaattttgagaaagttcaattttgttgcttcatcttttggccagtaaaacaggggtgctattacctgcatttcctttgccagagaattaagataaactgagccgtaagtggtaaagtgtgctatgatgcacatacagctccactacattatggcaatgctaaaaataacctgagaatgaaggagctttatttcttcatttccaatgacccatgagcctcctaaaatgcacagggaaagatgtctacccccaccacaagcacctgttcatgaggtcacctctgttcaaaataccgaagtcaatgaaatgtcagtggcaggaagttctggaatatacagattacacgagcccatttccctgcagcacagttacatcatcatcaagagaatgcattccccaaatccacggcttcctaatccattagcacaacaggctggtggagagcttggctttctcagtcacatgggccatagaatcaaaataaacacaaatgtggccagagtaacataagtcgaaagaatcccaagtaagccccagtctactcatgttcaaaggcacacacgctccaccagactccaaaacagacctcttctgaatttccttcccattttatgaagaaagtgtaaaatgaattgttacctgttttctcttttagtaggaacaccatttctgctttccaaattcctgatttactggtttcacagccataaaacatcaatgccaaggggctttataccagcaaaaacaaacatgatttttccactgtttttaaaagacagagttcgtttttgccccaattcctacatagtggtaagcttaaaatcaagccatttagctcacagtcaggtccaataaatcagtggaaaaaataaatgggagagcatgccaaaatgtaaccatggtaacaccacagatgcatcaagaaatggtgtgctcatttgcttcatccccatttcttaaattggaatctaagtaggggaaaaattacacagagaacaatcatgattctgcaattactgatttctgcaaaattgtattcaacctgctgtactataacttcagaggcagctacagggcacctatgaaaacagccctagatgacataagagtgaaaaagaccagatctgccacttactgaccctccccgtgactttgtttcttcatccgtaaaatgggtgttaaagacccccaacttcaaagggttactataggaggaatgcctgacagtgcagaagaagcagggcaatggtgaactcaggagactcgaagccctgatcacctatggctttaattttattggcttcctcattgcctcagtttcttgatttgtaaaaatagaatgataatccctgccctacctatgtgattagcattaggaattaattattattaagccaaaatataagaaattactacgaggttattactaggactacagtttataacttcaatgctaaaagactaaaagaactgaggaccacaagttcacattaacacatcatcacaacctcctctccgtcaaatgcagcttagccactccatggacagaggcaaccttggggccctgtcccaagttacttgcagcaaacctcttctcctctcatagcctctgttttattaatgagtaaaatggaaagccaggggctattctagaatctgatctgtggaggttatcatctagaactatagtctaagtcctttaaaatctacagaatgcctgagattagttctgcttattcttttacagaaagaattagctaatgtttatcagaaaacattagcactctagcatatcatttgcaagttttttttttaaaagaaaaccatttatagcaaacaaatcatagaaataaacacgatacctggaacattaaattattcttcctttcttttgctggttcaaaaaatggtatgtctaggaaaataaaggactgggtgatagagaggagaaaggaaaattctaagtaataaattctaagtaataaaaccagaatcattcttcccttgtattttaaaagaaattaaacaaccaggaacacagtgtgccacagtacagtgatacttcactacaacggagctgcgaatttatccaaccatagacagacaggctgcctttctttaaagacactctgctttcagcattcctatgttctgtgtcttgttttttcagatttggtgtaatctaatggtttgggggtttggattttttatctgtggaaatcatttctttgaacaaaattatacataaaatcctgacttatgaatctgatgaagttggccaaaaggagaaccctgggaaggaagacagagcccactggggtattcccttcactgggggtctccacaaaggtcagtccgaaggccgctggccaggtctactccattaataacagcaaatgttaacatttatggaggctcacagcacaccattaccttagaaaatgccttctgtgcctgatctcattgactcctcatagcagttccatgaagctagtattactaacacgtcctttccactaatgtgaaaagtgggccttacaaagggtagataatttgccccacattgcagagccatgactgaaacccaggcacaccacgacactgttattgaattatgatttgcttgagttaaggagtcactcagtaggccaaccaccaggtgttccagaaccagttgttgagatctcctttctcccctggacttttcacacacacacacacacacacacagcagtgagatgccaaagtccaactacttacaaggcacagcatggcggtaaaggttatcccttatggtctgctggagctcatgatcaggagaccccttctggaatcgctgattgagaaaatgtcgcaggtccttgttcagccttcctcctgcaggaaatacataaaatagacataccacatcaacacagggcctcctagaaaagaagtagccaagaactgattgcaagaaagccacaggatgcagttctagcctgccacccctagtcattaggaggatgtactttaggttttcctctgcaggggtaaagtcaagccagaatgtcataaagataaaacagcactggcaatgcattaatttagagatcctatctcacataatactagaaggccaaaatatcaaagtgtttaatgtaggctattacatttaaatatgtgccatagacacttgcagacactattactagaagcataaattactgaaaccttaaagaagacaatccagcaataactgtcaaatcataaaatgttctttgaccagggattcgaatggtaggaatttactctacaggtatacttgtaatctcttcaaatttccatgaatttactacagctttttttatttttttaatttttattttttgaaacggagtcttattctgtcacccaggctggagtgcgatggcgcgatctcagctcacggtaacctccgcctcacagattcaagcgattctcctgcctcagcttcccgagtagctgcggttacaggcacccaccactacacctagctaatttatatatttttagtaaagacagggcttcagaaccatgtagaacaggctggtctcaaactcccggcctcaagtgatccgcccgcctcggcctcccaaagtgttgggattacaggtgtgagccactgcatctggccctactatagctttttttatgacggtaaataaataaaaacaaagacctggaaacaaccaaaagggagcaattaaagcacaattcatccatataacaactactttgcataagctagattttcatgggttgacattgggagaaaatgtgtggaactgtgcataatgtctgattccttttctgtaaaaatgaatttggaaaaggagagactgggtaatacgaggaatcatatgaaagttttaacaacagtttcatgtacaaaaaaggacttgagctggggataaataagtagacttcactcttcatcacacagacagagagagagacatagacatagacatctccctatcctgtgttgcttttcaaacactaaatgtatgttgctttttggttgttgttgttgttgttattgttaagcatagttatctaagtgagtctgtgtttatttctttgcaattctctacacttaagagaacaaaagaaaagctaaaaatattatattatcacaaaaatgtgtcatagaaaagagatacatttgaaaaaatcataatcacaaattacagtctacaggatcaacagaaggcttgtagatcaacctaactagcattcactcttaatggagaaagatgcttcaatgacagctaaaaataactaggctgagactgtctttccatttttagacaagatacaaattaggtaagagcatttttagccttagagaaacaatgcagcaacccaggagtcacgtgagctacaaaactcatgccttcaaatggtaacttccctatggtcaaaaagagtaaatcatgaggatgacagtgatggttaagatgatggtatttcctacctagggcaggaaactactgatctttactttaatatcacattcaatataagattccagctacagctgctcattttgaaatagataataaaacccaatttgagctattttatttggtattctatctactgtttcaagtcaccgaaaggaaaaatacatatattcaaaccaatcttaggtcattcaatcattcatcaagtatttactgaatgaagacacccacatgccacatgaagccaccccccaaaaaaatcagcacaaggtttgaacagacagttcacaatggaatatatgtgactattaagcatataaaaagatgttagacatcattagtcattagaggaaaaataataaaatcacaatgagatcccactaagtaactacttgaataacaaaaagtaaaaagactgaaagtatcaagtgttggcaaggttgtagagaaacaggaactcaaatatactgtttagcaggcataatggttcgtcctcttaggaaaacaatttgtcaatatcttagaaagtcataccttcaatagccaagtgacccaacaattccacccttatttacatgacagaaatgaaaacaagtccacaaaaaaaaaaatctcgtagatgaatcttcacagcaactttacttacaaatagccaaaaattggaaacaacccaaatgtccatcgaaaggtgaatgaataagcaaactgtggtataatcaagcactggggtgttacatagaaattaaaagaaactactaatgcatgcattaatactgatgaatctcaaacacagaatgttgagcaaaagaagtcagacacaaaagataaaatattgcatgatttcattcatatagaaagttttgggatggactaaaaaattttggaacggactaatttatagtgagagaaaacagttcagttgttacagagagcggaaggtaggcaaaaactgactgcaaagggcataagggaataaaatctatggatctatgggtcttccccattggaaattgagaaaacagggtgaaggacttctacatgacttctatacatggaggattctatacacggggcctctatattattttttataatatcctgtgaatatataatatttttaacatcagtttttaaaatggggaacacaagggaagattctggaggagatgccaatataatattttctttttttaagatggagtctcattctgttgcccaggcttgtgtgcagtggcacagtctcagctcactgcaacctctgcctcccagactcaagcgattttcatgcctcagccttccgagtagcagggattacaggcatcttccaccacgcgcagcgagttttcatatttatagtagagatggcgttttaccatgttggccaggctggtctcgaactcctgccctcaagtgatctgcccacctcggcgtcccaaagtgctgggattacaggtgtgagccaccactcctggccccaatataatattcttgattgagattaataacattggtttatatatttgtcaaaattcacagaactgtatacataaaacaagtatgttttattatatgtaagctataccaataaaatcgatttcaaaagtttaaaatatatacagtgattggatgattggatgagtactatgtgtgagtcaatgttcaggttgcgtagttctctctttagagagttgaagtaaaggaaaaagaaagtaaatctaggtagttaagccagacgtgcctacttctgaatcctggctcaactgtttattagctggtgagtctgagaacagggcttaatctctgaaccttgctttcctcaactgtaaaaatagaacactgatgtaatattagctctgtcacaagattgttgtgaggattaaatgggatgatacattcagacagtgcctggcaaaaagaaaacactcagtgaaagatggaaattataattatgatgttgttgaatggacgattattgaggtgagggggcaaagaaagaaaatcagttcaaacatgaactcttactcttttttaaaaaaatccatgcaaaccaaatttattctattggcttagaaatagccagaaacaaaatatagacctaaggagatctggatgaaaggatatttctagtgtttctagaagtgaataaaaatctacctgtgctaaaatagtgtggacctatgtaaactcattaataaacatttagtgtgtggttaatgtattccaggcattgtgctggggctgaagttcaggaaatgaaatcaactagtaagtcactgatatgtgatctctctacctgctaactccagcttgaggtataaggcactctagaaattgagtaaaaaaataatgtttaccagcaaaattcccattgcctgcaatgtagggttttaaatttctcttaggtgacaagagttcttgacattaaaaagacactaacatttatcatttgagccacggcaaagacgtctatgatatccaaaatgcttaaatcaaaagcaacattccaaaggagttttcagatacagtaactttttatcacatatataacaaagatttgtacatccttatggatcatatgtggtaactatcaagataaaccagggacatatagattggaaaccattttactttttttatttttttggagacagagtcttaccctatcacccaggctggagtgcattggtgtgatcatggctcacagtagccttgaccttttaggctcaagcagtcctccagcctcagcctgccaagtagctgggactacaggcatgcaccattatgttcagctattttttaaatttttgtagatacaggttctcactatgttgcctaggctggtcttgaactcctgggttcaagcaatcctcctgtctcagcctaccaaagtgctgggattacaagtgtgagccaccatgccccacctggaaggcattcttaagtataagctcttggtttacacctaagcttatattcaaactagccaaggtagctagggtttatggtcatcaaactaaaactcccctctactgcagatgtgcaaaaagacagagtttactatgctgccagttaacatttactctgagttccatgacatttggacatgaaaagtctcaaccttcacattctattaaaaatactgtacattttggcatctaatctcaaattaattgccaattattcaagagacatgtctataaattgtctactaattgtcaagggcagtgagccaataaaataagttggaagacagtttgtcatagcatcttcactttctttgaaattcaagatttattttgtaaatagaaaagagaacataggtcagaaacacagtcatacactgtatagcaaagttccggtcaaagccatacttaccatgggtccaaaattacaacgccgtattttttctgtaccttctctatgtttgcatatgtttagatacacaaatacttaccattgtgttacaaatgcctacagtattcaggaaagtaacatactgtgcagattgtagcccaagagcaacgggctataccatacagcctaggtgtttagtaggccataccaactaggtttatgtaagtgcactctatgatgtgtgcatgactaaatcacctaaggccacatttcttagaatgtattccagtcattatgcaacaaccatgactatatatagaactttttccaagaaaggggttcagagtttattctaagacaattttatattttaactgaggaaaatggggcttagatgctctcttgatttgccgttattttatatttctgtatcttttttttttttttttttttttttttttttttttttttttgagatggagtcttgctctgtcctccaggctggagttcagtgacgcgatcttggctcactgcaagttccgcctcccgggttcacgccatcctcctgcctcagcctcccgagcagctgggactacaggtgaccaccaccatgcccagctaatttttgtatttttagtagagatggggtttcaccgtgctagccaggttggtctcgatctcctgaccttgtgatctgcccaccttggcctcctgaagtgctaggattacaggcttgagccactgagcccagctatatttctgtatcttatctatatatctggaattctgtgtcttctaaatttacagcaatgtaactctgcttttctcacccacatgagtttacagaatgttaagcatgtttgatggatgtagtttttcttattttaaatgttgtataatattcaatattaaaataaaccacaatttatttatccttcatagaaaattaagctatttccaatataaacaatgctgctataaatgtcattgtaatgcctccctcccctaatttttttttagcaaatgtgtggggtttttccctctagattatctaaacctgaaaatggacatagatatctttgatttatcttaacatttctgaattcatccccaaaatggtggtaccaatttgcctttccataaatagttttggtggtcctgttttcccacacttaggccaacattggctattgtcactatttttcaggtccccaagaccactcctgattggatgattcactaggaagattcggaggactcgttatatagttgtactcatggctatggtttattccagcaaaaagatacaaagtaaaatcagcaaaggaaaaagtctcacagaacaaagtccagagaaaatcgggtgtaagtttccaagtgtcatctccaaatggcattacacaggacacacacacattccccaaagaacccatatgaaaagctgcccaccggagaagctccttagacacccagggcccgggagttggtcatgtaagcagcctttgcctggcacaaaataaatctccagactctcggggaaaaaaagcataaatgatagcatttgggcatgcagtctagacatagtgagccactcttaccagttatcagaatagaagaaattccctgaaatgcaagttcccagatgccagccaagggccaccttagcattccatccagctgccactaactcttttctgcacattccaactttataaatgtttcccaatctactaaagataaaatgatatcttggtgttatattaatttataattactgattacaactgagagtgagcattctattatagtttttaaattgtcttttatgttttcctttctgtgacttgcctgttcacatttcttatacgttttcctattaggttatctagttattcttgataaaaagatattcttatatattctagatagggttcctttagcacttatttatggtataaatttttcttgccattatttaaacatgaaatgatcccctaatataactaagttgtgtcgtgtctctttttctgttacataccaactcttaccagaagcatcttttcaaggtgatggatgatgaggggaccctgcttggactgatctctatctcctaggatagagatctgaaaaggaatgttgctcagtagaaagaatctttgtggtcaagaaaccaggtttcccaagagaacacttttgagtcttcttaatgtatccatctgtgaccgagagggcagaatacaattccctgtgtgtattccatgtgctccacagctacatccacatccagaaggtcaaagaatggtatttcattacaattagaattgacactttaatacagttcaaattttcaatgctaaggagaacctgcataaggattttgaactaatcacactttcaggtgattctgctttagcacacaatttcttcaaaaaaatgattatagttgtaggaaaagtccatttattaggacaacaacaaatggtatgtactgcagtggtgctattacagcaaaaaaaaaaaaaatccatcagttcagcacttcagttttataaagaataggattttttaaacacaaaattataaattgaaaaacaaattagcttgttttatagtcactcaaacttacaatccaaaattcatttaagtgagctttatctgaaaaggatgtttgctacttgctttttctaatatatttttctatatttttttcttattgtaaaagcaatataaatcactggagagttaccctttaatgggtgcggagtttcacttgtggatgctgaaaaagttctagaaatggatggcggtgacggatgcacaacaatataaatgtacttaatgctacagaaccacatacttaagaaagggaaaaatggtcaactttatgttatatatatttaaccacaatgaaaaagcaatatgaattaatcacaagattttaaaaatacacaaacgtacaacaaacaaagttaaaatcacctgtgacttcatttacagcacaattaatattttggtacagtgtcctctgtatgcctatgtacctataaacatacatgcacacttataatacacttaaacatttggggagtttcattcactaattcaacatgtatttattaagtgcctagagctaaacaccctgtgagccctgaggatgcaacaaggacaatacagagcccctgagcagcagggtatatgcctgctttaggaaggacgaacagacatgacctccaggcagagacaattgttaaggtgagaactaaaggaggatgagaggctagctaggtctgcaaagtgttggggaaagactattccaggcagagtgaatggcatatgcaaaagtttcgaaggaggaaagaggttggtatgctagagaaacagcatgaagctcagacagagggtggctcaggttgaggttaaaaagagaagcactagtggataatgaaaaatgtgatatctatacaccatggaatactactcagccataaaaaggaacaaaataatgtcttttgcagcaacctagatgaagctggaggccattattctaagtgaagcaatggaaaaccaaataccatatgttctcacttataagtggaagctaagctatgaggacaaaaagacatacagagtgatttaatggactttggggatgtaggaggggagattgagaggtgggtgagggataaaagactacacactgggtgccgtgtgcactgctcagtgacatgtgcactcaaatctcagaattcaccactaaagaactcatccatgtaaccaaaagccacctgtaccccaaacactactgaaatttttaaaaagagagagagagaagcagtcgccagacaattctgtgccttgcaggccatgataaagagcttgcattttattctacgtgtgtaacaatgcactgagaggatttgagccatggaggtagaggacgtggtctaaatatcaacgtttcttttgcagttgtgtagtgtgtatgcacacgcagggtcatgtgtagaggtggaagtcagaagaagccagtagagctgatgatcacacaagtcctgaagtagcctagactaagggagtgtctaggaagaaggacaggaaggggcagagaagagatgtaatttaaaactagaactgatacagtttggtgacatgatggaggaagacaccacatgcaatggagtcaaaaaggaatccaatgtttgtgcttaactggtaatgaacagctttgagtggaatacagagatctattaggtatcttttaagtgtaggatgtgtaggatcatgccacatatatggatttatatctatgttttctaacaaataattcatgagcatttgcaatattagtgtacaaaaatatagttttaagggctacgtagtattttatctcatcaattcatcacaacctatttaacctattaccaattagtaggcataaaaattgtttctactttgattatcctccttgaacaaaatctatctgtgtacttctgattatcttcttgagatctttggagatattgaaacaaaaagcacaaaaaatgtttaaggcccttgatacaaattccctccagaaagatcatattagctttccttcttccagctttattttaaatagctccaaagtaggtacgtaaactcatggcaatattatgagtttcatgttaatagacatttgtggccagatgcggtggctcatgcctgtaaccccagcactttgggaggctgaggcaggtggatcacatgaggtcacatgaggtcagcagttcgagaccatcctggccaacatggtgaaaccccacctctaccaaaaacacaaaaaattagacgggcgtggtggcaggcacctgtaatcccagctacttgggagactaaggcaggagaattgcttgaacccaggaggcagaggttgcagtgagccaagatcacaccactgcactccagccggggcaacagaatgagactccgtctcaaaaaaaaaaaaacagatatttgcatgtctttctttaaaacaactattatacataatgctgtaataaaaaactttaaacataaaatttgctgaaatttcctagaattactagattgatgagtatgaatattattttaaaggttcttgataaatactcacaaaatgcattacctaaaggttatggcagtttctaccaaatctggaagaaattcagcatcactcaactgacaattacagtgtcaaaatgagactaatttttcccattttaattatggtttttaagaattttccaccaataatttgaacagatgtcaacaatgtattaaagagaccacatgatggtaaaactgtcccctttcattttgagaaactgcttgttctagtaagaaaattaatttggagtatggcttagtgagaaataatgaatgactgccatgatcatatttattcaactaaaaaaacaaaaactctcacatctaaaaaatacacaaataaagaacattcagtggatgtgttctttacacaattacttccaacctcccttctctaaacattcaagcattggtctaggtcaggggtcagcaaaatatttccataaaaagctaagataactattttccagccttgagagtgcacatgaactctatccaactgctcaattctgcttctgtagtgtgaaagcagccattgacaagatgtacatgaagttgtttttcagtgaaagtttatttacagaaagaggcagatttgtcccttgggccatagtttctaaatcctggtctagatgttggtcatgcctcttcaggtaaggaattctccttaagtaattgttggggtagagttcaagtaatacttggtgtggaggtggagggtgttccttgtctcccaggttagtctatgccagtggttctcaaagtatggtcccatgagactggcagcagcagcaatacccagaaacttacatgaaataaaaatgactggtctctaccccaggacttgatagaattagaaattctaggggtggaggttcagcaatctgtgttttaacaagccttccagatgattctaatacctgctaaagtttgtggaccaatggtctcagccacatcaaaacgtcctaatgaaatatggggagctaggctctatttctcacagcaggtcctcatctcttgctaatctcaagtgctgccaccccactgtgcggctgacaataacaggcacacaccacacatgactccagacacggggtacctcaacacacatgcagagatggaagctattccccgagtggtacaaagactattgttcttttagtcatgtttctgtaaaagttaaaaaatacaaacaaaaaagaaacgtgtggtgagtgtgatgtgagagagaggctgcgagacagatttatgtatgctgatgaagctcaagaagctactatttacatttaactccccacatgagcaagcatgaaacattttgctagcacttcaggaaatccactttattattattttctgcctgccttctctgttcttttctcttggtgaatctttttattataaatttcatcccgcagtgagaaaaaatttgaattaagcatggaaagaaaagcaagcttaggtttaaatgccatcatcttgattttttcattatttacagcctttggtgcttcttgtatttattccagttacactaagatagtggaataacatctgttcagaaaaaaaataacaaaggatttatatacagaaagcagaaagacaatgttcccctattggtaaagtaatatagctgatgtgagcttatggcatgccctcgtaaacagctgcatagcctcaccaaaagctgaaatcaagtgtctctacattcagaatgctgagtggaatctaaagatacgggtgtctgtgccctttgagaatattctaaattcttgaaaagatactctattagaattctaactggaccaattggactcgagatgacagtgaacactgattaagtactttcaatgagccagatagcaatatgaagcaataactttataatccttactcccacccaatgagattactagtctcattttacagaagtataaactgaggctcagaagttgccccatcacccaggtagcaagcaacagaggagacgggactcaaatccgggggagtatgactgtctgtgttcttgaccagagaggtctaggaaatgttcacaatcagaatgataataaagacaaaccaggaagcaccagtatagaaaataaaagcaaaaaaccaacacatattctttctaaattcaagttcttgtacttgcaaaggtttttaagccagtgcctgattctgggaagtctcccaaaagcatagctggtgctgtagaaatttgttgatatgatcagtgtccccacagagtgtgtttctttcagtagtatatggttaagagtgctgaacttcaagcgaggcttgattagttcagatcgaggccccaaattcaccagcttgccttgggcatgttgctgaacttctctgagcctcagttccctaatctatcaggtggggataataatagtatctgctcaaaagggctgtgcagcttcatgagatcatgcactaacgcaatatccagtataacacatagtaagtgtgcagtaaattgttacttttaccaaggctcataacaatgcagtgtgtaagcttgattagatctggaatttaaaaaaataagaacaacagagacgtttatggctcagctaagggaatgttgactatgaactcaaagttcgatgatgttactgaacgaatgctgataagtgacaactgcatcatggcttgtaggaaaatgtcatcattttgtggtaatttttggttatttggggatgagttatcatgatatctgtaccctaaactcagataacctagcaaaatggaaataggtgtaaatatggacagatggcatgggtgtagcaagatgttaacagctggtgaatcctggtgatgggagtacatgttttgttgttttttcaacactagcgtgggtttggaaactttcaaagtaaaaaagtaaaataaaatatatatatatatttctgagacaggctggagtacaatggtgtggtcgtggctctctgcaacctccacctcccaggtccaggtgattctcccacctcagcctcccgagtagctggaactacaggtgtgtgccaccacatccagctaatttttgtatttttagtagagatgggatttcaccatgtcagccagggaggtctcaaactcctcacctcatgatcctcctgcctcggcctcccaaagtgctgggattacaggtgtgagccaccatactcagccaataattatttttaaaagcagttacagtcataaggacactgtaaaacatctatgtgaatctcaatataaaaaccaaagactgactttccttctaacctgccacatcataaagttgtccaaatggccctctcaatgcctaccatatgaagaaaccaagagagtgacatctgaatggcacagacttccagagaacactcagccaaggcataagagcaaggtttgtttccatgagccagcacccaggggtaaacccttgtaatccagggttttaggaatctgctgacaggtaagatgttttaaatgtttttatgcaaatacaactgagatcccattggtattccacagccttgaacatccatagtaattaacacaaatgttctcctaccctcccagcctcaccccaatttattcacagactggaatagataatctggattgcaaactgtattctaatatgatctgacgtcattcatgcaacagttggctggggccagagttctaggtgctctgacctacattgggaaatctcattctgactgcattacagtatagcatgccacttcaatttctactggactgtgagagcagaaaccactgtgatacacacatcatttgatgggtctgaaaaaagtgacacaatttcccatcaacagagcatccttgagtctattctctacacagcgcctctctttaaatagtttcaaattcagaaacaaaagagagagtcacaagtaatcgccatggtcccggggcagagggaggaagagggatacgggaggagaggggcacctattttatgtaaatgtggttgtgtacaaaacaagttctagacttatttcatatgttgccaacccactaagttaaacattctcaaaccattaagattcatctctctgattgaccacagctctcatttttcaagaatgtggtacatagtgctcttatttaaaaaatatttaggggagagagttctaggctgattatcagatatttctaatctccataattccataaacgattataatttgcacactccactattttcattccacctcactgtagtcttccagctgctattcaaaagtgattataaataatggggctataaaagccattcagtaattaggacactcactggccatatgccaatcttgacaatggaaggtgatttatgtaagacaaccctatcacatctgccatcctggtttcccctctgacaggctcactggtcacgtattaacattgcccttaatgatcatttttttcttgactaaagagcaaacgggcaacccaaagttctacagctttttttttaaactatgtttataagggaaaacacatacacacacacacacacacacatacacacacacacacattaagccatttattttctgtcttgtcatttaacatatccagagaaaggagagaaggcatagaatgaagtaaactggatcaggtaaaaatcctggcacttgccatcaaataggaaagacctcaatgaattccaagtacaaaaacaaaaaacttcagacccagccgaccaaatcttatcccctcagcacaaaggcttcaatatacacaaggttaagcccattgcaggctttgcctagtgtttctcaaaaggagtgccactgccatcttgggcaggacaattctttgtcactgtgaatttgttccatgaaactctggacattcagcctccctgttcttggcagctccaaactaaatgcatggtgtattccctagttactgtgacaaacctagtgtgacagtcccacccaggggttgggtaaacatatagaaattgggaacagttatacttaagtgcccctttacacatatgtggaatcttctttcttatttttcttttagagcaaagagcatattagaaaaaaaaatattgcaagctgggcatggtggctcctgcctgtaatctcagcacttcgggaggccaaggcagacagatcacttgaccccaggagttcaagaccagccttggcaacatggcacaaccctgtctctaaaaaaaatgtaaaaaattagccaggtatggtggtgcatgcctgtagtcccagctacttgggaggctgagttgggagaatcacctgggcctgggaaatcaaggctgcagtgagacatgatggcatcactgcatttcagcctaggtgacattgagaccctgtctccaaaaaaagaaagaaagaaagaaagaaagaaagaaagaaagaaagaaagaaagaaagaaagaaagaaaattgcaaaagggcttatattggtgatgattccaaattgttgagatttgatatgcacatgcatatatttccatacatttcttctagcacagggctgttgtgcgaaaggcagcacggtttagggctgggaacacaggtacgaaaggctttctctgaaaactgtatctaaaagacactgctccatcagtgtctgttctattgctctggtttattgcattcatagcagttatgattctttgaaattcttatttatatatttatcttgtttattgtctgtcatccccaccccccaaaccatgagagtttcctatgaagactgagatcctcttagcctagaatagagtctcttggactacaggaggagctggcatagactatgtgactgaacaagtgagtgaataaaggatgatactgctaattaaaatgacacaggcagtggctaaagcagaactaggcagacctaagttcccatcctgactttgccatctgctgcctctgtgtgttcttgggcaacttacttaatcactctgggtctccatttcctcatcagaaaaatggggataagaatagcatctacctgacagggctgtcatgaggactaaatgagaatatacaacgtaatgctcactaatgtgagctaccctttccttcatcatctgacttgaaagtgacatgattcaaatatacctttcatgaaattctattctccaagaaggtaacagaaaagaattttttttaagattcatgattatgacaatgtacaaaacaaatgagttaaacaagccagcctttccatatctccagactgcaaactaattaaaactggtgtgttatcaccagattgctttcacacgcccgcttctgtttgtactacactgtatggccgaaggtgtgcaagcagagacagaatttccttccttcctcccacctcaggcctcaagtagctgggactacaggagtgcgccaccatgctctcctgattttttttttttttttttttttttttttttcagacagagtctcgctctttcacccaggctggagtgcagtggtgcgatctcagctcactgcaacctcctcccaggttcaagtgattctcctgcctcaaccacccaagtagctgggactacaggcatgtgccactgcacccagctaacttttatatttttagtagagacggggtttcaccatgttggccaggctggtcttgaactcctgacatgaggtgatccgcccacctcagcctcccaaagtgctgggattacaagcgtgagccaccaggcgtggccgtggcttatttttttgacttttagtagagacaaggttgtgctatgttgcccaggctggtctcaaaatcctgagctcaagcgattctcccgccttggcctccccaagtgctgggtttacaggcatgagccactgcatgctgcccattattttcatttgcattgccctgatgactgacaatgttagtcttgtcaagtactaacagaagtgtcttttcatttgttaagtttctattcaaattgttcatcagtgtatattggttgtcttcttaatgttgacttgtaaaggccccttatatatccctcatatcagtcccttgcagaaaaacatttttcaagtattctctcccagtctgtggttaccaattcattttcttaatgatgccttttgatgagtggaaatgttctatgttgaaatgaagtctaatttatcaatttttatggttattttttctctattattaatttactacagatgagtcagaaaacaaaataacgaaatagaagaactctgggcaaggagtcagggggcctggatttgagacttaaatctgcacaggtatttgagtttcgggaagtcatctgggagggttgattttatgtgttaacttgactgggccacagcatgtccacgtatctggtcaaacagaattctgggtgtttctgtgatggggttttgagataaggttaacatttgtatcaacggactgagtaagccagattgccctccttagtgtgggtgggccccatccaatcagttgaaggactgaatagaacaaaattactgtccttcctccaaataaaagaattactttccagccaggtgcggtggctcaggcctgtaatcccagcactttgggaggccgaggtgggcagatcacctgaggtctggagttcaagaccagcctgaccaacatggaaaaaccccgtctctactaaaaatacaaaattagccaggcgtggtggtgcatgcctgtaatcccagctactcaggaggctgaggcaggagaatcgcttgaacccaggaagcagaggttgcagtgagccaagatcgtagcctgggcaacaagcgcaaaactccgtctcaaaaaaaaaaaaaaaattacttccgtctgactgctttgagctgggaatcagtttttcctgtgttcagactagaactgaaacatgggctcttcttgggttcaggtccaccagccttcaaactgggagtaccatcagctcctctgggtcttcagcttgtcatgtgcaggtcttgggatgtgccagtctctataactgtgtgagccaattccttaaatgaaatctccttctctctatatatacatcctactggttctgtttctctagggaacactgactaatacatcatctgcctcctttagctccaacatagcatgaagcattctactcaattcttaatgaatattgctggaatgtctaatacatcggctctaattcacatatgtataaatgaataagttggattcgacaaccccagaggcctctcctgttctaagagcctctgatacttatcttgctctcacctttccattccaatgactccttttccctcaggtgtcctccaccaaaattaattcggctgtgcttctcagaaaaagcgacaaagctccctcccagctaatcagcttagaagtaattctaacaggctccagctacatagaaacctgttctggtttgattgtcctcacctttttggaaggaagctgaagagttcacaaaaattcaacattgttgtatgtttattcacaacaagggttgcagcagttgaattctcttaacttcctctccgaatatattgcttatatactgacgtatttacccgaatcctaaaataacattttaaaactgcaaggaagataccaaatgcaccaataaatccaactaacgagtgttcctattagggaagaaagtccctgacacattatagttcccaaaacacagaaggagatcaaacgtttgtcactgaaacaaactgaaataggtccacacttcagcctttgggaactgtgacaccctcttttttgttgcttgattccaaaccagtccttatgagaaagaaaattatctttacccattcatgtgactttaaataaattttgcaatgccctttgagaccaaaccacacccttggagataccaaaccacaattgagaatttttgctttctaataagcctatattaaaaaaaaaaaagtaggtgatggtgactgagagctatagtaagaacctgaagggattcagttcactaagcttccccacatggctctaacagcaaaagcacagagctgctctctcttggggtcctggaatgttctaacgacaaggcatcagccaggcttactcagagtggaagtggcaaccgaatgttgttacctctaagacagggaagtaaacttcaatgaacactgaaatcacctggggcatgtctataatagcaccagcgcctaggcccccacttcagaccaattcagaatctatagggaaggactaggcatcggtattttttttctaatctccactagtaattccaaagtgtagccagggttctaagcctagcctacttctcagactgtgaattcacggtagattcactaattgtcaaaatatacacacagaatcttctgttgatagagcatcctgtataatctcctaagatgaagtgcccttagcttcaaagaagaaatataagactctgaaccaggtgcagagagtggtacgggagtgaagaacatcaatgagataaggaagtggaaaaattctaacaccctcttagagtcacagccctgggaatttaaatcgtgtttctgcctgccctgactaaggaagaaaactgaaattagctgggtagaaatttcatctaaaagaatcaggagactccaagtgacctgtactttgatgtctctcactgtggctcagccacgcttttctctttcacaccaattcctgagaaaagtcatcagtaactgatatgtagtttgaagaacagacatcaaatacaaaggatgggttaggggcccaaggtttctgccaggctgtgatcgatgacaaggaacaaggtgagaaagggcctgctgggatcacaaatgcagggctttcccacactgaaatcataataatgatgtcttaaaagttgcacaggctgacttctgaaggtgcacaaagcaccaacacatttagaaagcactggaaaagatgaaagaacaaatagaaggctccccaaaattaaacacaactcaacatgactgctgtgagctgggtaattatctcgttgatggattctacactccagctaacactgaaccatgtgctacctcaaaaggtttcttcaagcaccagcaccaatgaatgcttgcagccactcccatatcttgatcaagcccttcagtgctcacaagaacaatcaattttctttaatgagacattattctgccactggtcaaacatgctatgaccatcaaaccttctatccggaagactcgaagggaatgaaaagcctttgagaattttacatcagcaaaccaaaaatacttaaggctagcagaaaaccatcttcttcaaccagataccaaaattttgaataaagtgtttttataatgacttagctagacagtccgccctatctataaccttgatatgtaagctctgtttatacatactgaagtcatactggcatctcaaaagttcaagcaaaatcaaatcatgaaagtaaatcggttacattttctatcctttttcttgataaaaagaaggctagcttaacatttgcttttctccccataattagaaagattctggaaagagaaaatgtagtcaaacaggcttgagcagaaaatagcttttttaaaaagtgccttatataaaagaataacaattaaggaataaagctccatctctcatttgataggtattacctgcctggaaattaaatcatacttagtgctttctctagagaagacttctgttccaaaatgagggtctaatgttttgagtggtgcaagccaaatcagcttgaagaaacagaaggctctgctaagctttagcagaacaagccctaacataatatgccagagaacacgtttgacaaaacagaagtagaaaaatattttcaaaatcagttcttggcttaaatatagcatttggcacctccagtaaacacagaggagaagatctaacttggtagcaccatgtgactttctgaactgcagcagaccagatggtggggtgagttattcatttctcagctcctcacccacttttcccttccattagtgacttctcagttcagggtcccttagaagagctggaaataaaagaactggataaatacatagaactagttttcttagtacttattattctactttaaaaccatgttactagcaaacacctcatgccaactcaacagctcttgttagtaagtgttctggattatatagtcaagtcaatgtctcatttgctatctacgaaaaataaagagggtgacacttccccttctgtaaagatagggcagacatacctttccctattcctcccactaagtacaactataggccttggatctaggaaattaagaagatgtctgaaatgtaaagagaaaaaggcagaccaactaggaaccttgggacaaacctcaacatggtgatgagtttcatgggttttctttatgtctcatatatcccagaatcagagctgaagaacccaggaatgggtaaaaaccaagtgggatgaaggaaaacaacaacaacaacaacaacaaagcctgttctctctagctaaagaattagggaagaaggagggaaactggcaataaggaaaactgttacacaataacggctctacttcagccaaataccacaggaaaagactatacttccaccaccacccacgccagcaatgattgaatggggagcttagaattccgcccttttcagactgtattggggtcacctaatctctgctcctcattctggggtactgtcaaagaagactgagtaaagacagaatcttcgaccccatgggtggaatctcttcttctccccacatcccctcttccttatccgctcttcatcatctttggagaccccagaggaattcagcacttctgccccacatagcagtaatatgaagtcattcctcccactgaatgtcaaaggaagaagaggagtgggaaacctagacttctacccccactggactgtaacaaggtctcatatctccttcccctaacaaagtggtgtcagataaaaccatctaaaacagaaggtttaagtaagtttcagtctcataacataatatgcaaaatgtccagattttaattgaaaatcactcatcatatgaagaataaaaaaaactcaacctgaatgaaaaaggcaagatgacaaaaatgttacaattatctgacaaggattttcaaacagtcatcctaaaaatgattcaaggaacaattatgaacacacttgaaacaaacaaagaagtataaaacctcagcccaaaaaaaaaaaaaaaaacccagaagacatagcagggcaggaagctaagacgagcagatttcttgagctcaggaggttgaggctacagtaagcagtgatcgtaccactgcactcagcctgagtgacagagtaagccctgtttcaaagaaaagaagaggaagaaataaagataaatagaaattttagaactataaattataaccaatgaaataaaaagctcagttgataggctcgacaagaaaatggaggagacagtagaaaaacattagtcaatttgaaggtaggatattaaaaattaaaggccacgcacagtggctcacgcctgtaatcccagcactttgggaggctgaggcagatggatcactgaggtcaggagttcaagaccagcctggccaacttggcaaaactctatctctaccataaatacaaaaattaggctggcatggtgacgcacacctataatcccagttatttgggaggctgaggtaggagaatcacttgaacctgggaagcggaggttgcagtgagccgagattacaccagtacactccagcctgggtgacaaagtaagactccatctcaaaaaaaaaaataaaaagaaagaaaaaaaaaacagtgaaaatgaatggaaaaaagaaacagagcctcagggatctttgggactctaacaacagacctaaaatttatgtcactggaggcccaaaagaaagaaagagttaaacatttacttaaagaaataatgacaaaacatttcttaaagttagcaaaatatataaaaatagaggttcaagaaggtcagcaaacccaaaatagaatgttttaaaaatccacaccaaaatatactcaaatttttgagaactgaaagaaaaaaaatattgaaagcagtgagagaaatactaccttacatagaaaaaatagagtgacagtaaatttttcatcagaaaccatggaaacctaatagaaaagggtacaacatttttcaagtcctagaagaaacgaactgtcagcccagaattctacatccagtaaaaatattcttcaggaatgtaggtgaaatcaagagattctcaggtaacaaaaaattaatagacttcattgacagtaaacctatcctaaaaagatgactagagaagttctctgaaatgtggttataaaagtaagaattttaggacaaaaagagggaagaaaaacaatgaaaagagtaaaagtacaagcaaatacatttctcttctcctactgagttttctaaattaggtttgaagctcaactatctcatgtggctctaagagtacatggaggaaatatttcagacaatgatattataaaccaggatgtaaagagacgtaaggtttcagcaattcagccaaactggtaaaatgaccattctacatatagttattttatatacttttgagtatatctatttttacagcccttttagtattatatataatgtaacacataaagcaatactaaaaaggctaaaaagagatatgctcaaaaacattatagataaatcaaaatagaatgctaataaatgctcaacccacaggaagaataaaaaagaaaataaaagaataagacagaataaatgaaaaataaaaaataaaaagacataatttttaaggcttaacatgtccataattacatgaagtgtaaatcacctaaacacaccaattaaaagacagaggttagcagaataaatttaaaaacataacccaactatattatgttaacaagaaacttgcttcaaatataacactataggcatggtgaaagtgaaaggatagaaaaaaatatgcaaacattaatgaaaataaaatagaaatgctatgttaatatcagacaatgtgggctttacagcaaagaaacttaacatagacaggaagagacattatgtaatgataaaggggtcaacccaccaagaaaacatagcaatcctaaatgtgtgtgcactaaacaagagagctgcaaaatacataatgcaataactgatagaacagaaaagagaaaggaacaaatcaacaatcgttgttagagactttaacatctctctctctttctctctctcaataattggtagaattagaaaatttccaagatgtagaaaaactcaacaccttcaaacaacaggatccaaaagacatttacagaacaattgaccaagcaacagcaaaatgcacatttttttcaagtgcccacagaacatataccaagattgaccgtgttgtgtatgataaaacaaatctcaacaaatgttaagcgtcgaaagtatacagaatgtgttctctaaatagaagagaaccaaactagaaataaataaaagaaaaataggagtaaacctctaaatgcttagaaatcacacttgttaaaacaaaactcatggatcaaagggaaaatctcaagagaaattttaaatacacatcgacataaataaaaaaacaacgtgtcaaaattgtacaattacacgtaaagcagtgctaaagggaaaatttacagggatcacattagaaaagaagattcaaatcaataaactctcttatcacctcaagaacccacaaaaacaagaacaaaataaacccaaacaaggagaaaaggggaaataataaggaaaagagaacaaatcaatgaaagtaaaaacagaaaacaataaaacaaagagatgattctttgaaaagaccaaacaattgataaacttctagcaagactgacaacagggaaaaaccaacttaagacacaaactgccaacaatatgaagcaaacaaaggatatcactaaagaccttgcatacatcaaaggataaaggaatattatgaacaaatctacaaacatacatttgacaactgagatgaaatggagtttgaaaaacacaaactaccactactcatcccatataaaatatataatttggacagtctgaaagctgttaggcaaattgaagagaaaacaagatttcccaatttattttatgaacctagtattactctgataccaaaaccaaagacagtaccaacaacaacaacaaacagtggaccagtatctcccacaaacctacatgtaagcattctaaaaaacaaacaaacaaacaaaaaacatctcacaaactgaatccagcaatatatgaaaacaatatacactatgaccaagtggggtgattattccagggatgcaaggttggttcaatacctgaaaatcaattattataatctacaatattaatatgttaacgaagagaaaccacatgatcatatcaactgatttaaaagtatttgataagattcaacattcttttatgacaaaaactttaagaaaactacaaatatgcaagttccattctttatgtgaaattaaaaaagaaaagaaagaaaactacaaatagaggtatcttgctggtaaagaatacccaaaaccctacatctgacgtaataattcatggtgaaaaatggaatacttttccccctcagattgggacagcacaaggctctcaccactgttgttcaacaaggagctagaagttctggccaaagtgttggcaaaaaagagccagaaaagtaaataaaaggcatataaatcagaaaggaggaaattaaactgtcttgttattcctcaaatatcatgattatctacatagaaaatcccaaggaatctgttttaaaaacaaaaagcctcctagtactaataagtgaatgcagaaaagtcacaagataccagatatacatctgaaaatgaatgtatttcttttttttttttcttttttgaaacactgtcacctaggctgaagtgcagtggcactatcacagctcactgaagcctcaaccttttgagctcaagcaatcctcccacctcagcttccagagaagctagtactacaggccgtgtgtgtgtgtgtgtgtgtgtgtgtgcgcgtgcgcgtgcacacagacagggtctcattatgttgcccaagctgttcactaactcctggactcaagggatcttcctgcctcagcctcccaaagtggtgtgagccactgcacctggccttaatgaatgtatgcctatatattagcaatgaacacaatgaaatcaaaataaaaagaacatttaggtataaatctaacaaattcagtacttgtttactgaaaactagaaaacagtgatgaaattaagatcccctaaataaatagtgatgatacaccacaatcaagaattcaaagagtcgacacagtaaatatagtataattctcttcaaactgctaggtttaacgtaattcctatcaaaatcccatgaatgttttttgtagatatagacaaaattattctaaaattcatatgaaaggcaaacaaactggaatagtaaaaaattttgaaactgaagaataaagatcagcttacttgattttacaacttaatatatagctacaatatttaagactacgtggtattgatggggatgcagacacacagattaatgggtcagaatccagaactcagaaacagattcattcaaatatgcccaactgatttttcatgaagatacaaaagcaattcagtggagaaaggacacccttttcaacaaatgatactgaaacaattggacattcacagccaaaagaggacaaatgttaacttaaacctcatatcttacacaaaaattaacccaaaatgcatggtagacttaaatataaaactataaagtgtgtgaaaaatgaagtacacctgtaatcccagcaacttgggatgctgaggcagaaggatcacttcaggctaggagtacaagaccagcctgggcaacacagtgagacaccccaccccaatctctaaaaaaatacaaaaaattagccaggtggagtggtgtgcacctgtagttcctgcttcttgggaggctgaggcaggagggttgcctgagcccgggattacaaggttacagtgagctgactgcatcactgcactccagcctgggtgacagagaccctatctctaaaaattaagcaaataaaataaagtaaaatgtgtgaagtctttggtatctggatctaggcaaagttttctcacaccatgacaacaaaaccataatccataaacggaaaaaataatgaactgggcattatgaaaattaacaactttttttcctgcaataggctctgttaagaggatgaaaagactgggagaaaatatttgcaaactatatatctaacaaaggattagtgtctatctggaacatataaataactctgaatattcaatagtaaaacaacaataacaaataacccaagaagaaaatagataaaagatatgaacagactccaaatatgaacttttcactaaagaagatagtgatggcaaataagcatatgaaaagatgtctaacatcattagtgattagagaaatgcaaattaaaaccacaattagctattactacacacctatcagaatggcaaaaatattgacaacgcctaatgctggctaggatacagaaagctggatcactcatacgctgcctgtggggatgttaaaatgatataggcactctggaaaatagattggtagtttcttaaatacctaaacacaactaccatttgacccagtgctatagtttaagtgtatcttgccaaaaatcatgttttggaaacttaatccccaatgcaacaatgttgagaggtgtgacctttaagaggtgatcatgactggattactgctattatttcaagaacaggctggttcctcataaaaggatgagtctgcattgcacctcatgctcttgcataaatgctctggtgctcttccaccctgtgccagatgaaggcctcttgaccctggacttctcagcctctggaactatgataaataaaattcttgtctttataaattgcctagtctgtgacattctgttatatcaatgcaaaatggaccaagacacccagcaacagtactccttgacattaattccacaacaatgaaaaatcatgcccacacaaaaacctgtgcacacgtgtttttaggatagatggttaaacaaactgtggcacatccatatcatggaatactactcagcaataaaaaggaaggaactattgatacatgcaacagcctagaggaatctccagggaattatactgaatgagaaatgccaaatgggggccttctgtgtaggcaagggacagagtctcctgtggagggagcacatccctgtgttaacaccttgatttccaacgtctggcctccagaactgtgagagaataaatatctgtgtttttaagccaacaagtttgtggtaatttcttacagcaaccacaggaaatgagtataccagccacatcagtgacctgggaacctattaggagtccagattttcaggtcctgatccagactttgtgaatcagaatttggatttaagcagtgctcccaggtgataagaatgcaattaaagtatgagaggcattgacataaactactatacgattcttacaatttacagcaatgacttttgtaccaatgtagaaagtatttagttatcaacgtgtaaaataagtaaggtgcatatctgaaaaatgcatatttttagtttttcttggtgtgtatatagtcaaagtctgaatgaaaataagcaagaccaaaaaaattgtttctttaaggtgaagggattgtaactcccccaaccccacctagtcctcattttattctctataattctgctaatttattttatgataacttttttaaggccagcagacttacatgaagatcggcatttgccttttttgcccactgctcttctaggatcacgcgtcacacagtagaatgaaatcccacattatggacttatccaggctcattaacaaccaggtgtacaaggaacctgcctggttttagccaattcaacctcatataagaagaacaaaacaaaacattgctccagataattatcttttgaagaaacacccaaagcagttcaaacacaccctggagctaaggcaaagtagccagtagagccatactccatgcaagtccaaatctttgggtctacatttattccaggatgcagatctggcagctagaaccccaggaaacactcagtgccttgatggtcatggtggttagctgtgcacatggagacctttccctgtatattgcggcatgtggacctgcacattaagcccactttgccagtcatgtggaatcagcatccaccagacaatgaagtcaattaactgttcatcagtgagtcaattgtcaaattatttgtctccttctttttctcactgcagacagacatcccaggcatgccatccttgcatatgacaccaagaaaacaccaccagatatccagaggatccaagagagaatccttttttgcatatttgaaagcaacaatgtgccccattcacctccaaagttaatttttctaatgatttggcctataagtcaaccttctccccactcatctcaaagtgactacatttcagacaaacttttcagctcatctttggagaatgtatctctccagttcaaacatgctctaggaatatttatatgtaaacatctaaaaacgtatcttctctagctattatgctgaagggaaaaaaccccactctaattaaagcactaatgctaagttggatgaacaaaacaatatctacttccaaacttcaacaattatttatatacatgcaatccaaaatgaaaaccaaatgagaaatggttaaaatgagttttattatcgtgtctagactagtcacgcctgtgcagtggagccattatttaaatatttttaaactctgattatcaaagggggtagataaataattcaacactgtaaaaatttttgttttcacttctagatatgttgccattgccattatttaaatgtttcaagaagaaaataggattcatagtcattcaaagtgactaacggggagagataacctacaaaaataaattatcactttaaatcagggctctcaatcttagtactattgacacgtgggaccagataattctttgttgttgggagaagggggtcttgctcagcatgtaggatatgttagcggcacccctggtctctgtccacaagacaccacatgccagtacttattccctaccagctggtgacaaccaaaaccatctccagacattgtcaaatgtctcctggaaaataaaatcaccctcagttgagagctactgctttaacttagggactagggcaacctagttgaattctcaaatgtaactcaactctcctttagccctctagggatttcgtggtttgcaaacccaatagaatgactgtcaccatttagcttcctatgaccacattttaggaatcacctgagttttagtaggttttcatgtaatgcaaggccatggcgaggctttacagggactgaaataatggcaatattaactggccactggttttcaagagactaaagatgtaattcggaaggctgacaccaatgaccggaattattatggggcatacctgagaaagccatgatgcccaaaacttcggacaagaaagctatagtcctggcctaagttactatcaaaaatatgaccacctattagcctaaattgctggagtccaggacatgtgagtcatcagaagtctaccaggagagcttatccagcaagaatccgggtcacttgtagtttcagaataatctcaatgagatgagaaaacttgtatacttttttttcttccccagcggaaatatgcattaatatcacaacttgagtaggaataaagagcaccttcttggaccacaaagtcacctttgactccctccatcttccatatctttcacaacatatcaactgcccagttcttctaattccacctcctgtacagctcttgaatgagcccactcttttccaacacacctttcactactagaccattacagaagcctcctaatcagtcgcttaccttccactttggccccttccaccagacataaagcaatctttctaaaagacgaatctgattgcctttctccagtttgcattctttcatgggctttccgatgtgcttagaataaattacagacacctgcaagcttccgtgttatcaggaccatgacttaatataaggtgtcatggatgtggggcacagaacacaatgtcatgtgcaatgaaatcacacttatgcaggattttgtactacaggagtttataaaacccgaatcattgatagcacaaattgcatttaacaattccctaaacttccagaatctggacttttgggagctcaaaagccaagaatcaacccctctaagtttctctttgcatttctattgtacccttcctaaggcagtgaaagggagttaggccaaggttattttaaatctagcagggttgtgagttggggaagaagaggcataattaacaaaatttcactctctctttctttttataaagagtttttgttacactggtggagtctcactgcacttaccatgtgactccagtatataaaacacaactccaactatgttcaaaatatgcatacacataggcgttatatttccatggtgaggaggaggggattgctacacacagtgaaatatgcaaggcaaatgaactagaaagaaatacagccatatgtgaacaggaatatctctggatggtgagattagagatgattaatttgattctcaatactttcatgtatgttccactatcaataatggaatttttttaaactctaaatggttactttaagtctttatattaatatatggacctagatatagaatacatggcaaaggtaacattaaattgttttagaatgaaaagatttatcacctgccctgattcttctcagtttgcagatctttatgcccagataacagccccagaatggaaactgttgtcatttgatgctttcacacgtcatccccaaaatcaatcatctctaaggtttttaacgtacacacggagatatacaaaactgagggcgtaaaaatgtccagtgaatctgttaagtgttgcagttgaatattagtgcctgtgtgccgttttgtggaatggtgacctatcatgactgtaaacaaagagagaaaaacagttatgaagtatggcagccttataataatcagtgaaaagctttctctgccagcactttcaaatagaagattccatgaatattaaaagcttcaaattcaaatctccattcaacacacaccattgagtctctttctgtgtgctagtgacatatgagtaatgactttttttttttacattgaagaatatccttttcattatgggtataacatgatgagtgtgattagatacccatgtgctaaatgttacatactctctcctctactcacccagaagctgcagtatgggtcttggtcagggcatgaagtgaacatctgtgtggggcccaccaattgctctgtcaactgcccactgcatttctttttctaaatttctgagtgctgggctcaaatgtaagaatacaagctacattgactttattgcccagttgttataaaaatgtaaaagtttaagcatagattgcctatggagcgattatatgtgttttataattgtcaaatcatttaagttcaaatgaaaatgcatcttgccattacccaatttattttatatcaatttcaaaaggtgaatactggctccagccttggaatagcaagcccagttgcaaacattataggagtctttataagctccctttattacacacagtgtgtcttcctaccagtgtaaagcagggtagagtggagcggggatgtctcattcaacttcccggccttctagcattatgacaatatgatgactgtgaggacagacagagacgtagagcggagaaaaaacagtgtctcaccacctgtagtcccagatggcattggaagatactttactgtaaacccataaaggctcaaaaaacacataaagcaatgcactaattaaaaggaaaaaaatctacatccaaccatacatagttatggtacagattattacatacacagtcaactgtgacttctgaaatataactgagtcaaactccagcaaaacacagatgacaaaataaagagctcttctgttcctccttccactgatggtacaatggaatgcatacagatctattaattcaaagagttttcccattttcctcaacttgacatgcagaggagaatttttgagttgtcatcatccatcaccatgataagtacaatttattgccggacagtgctaagtgctcgcatacattatttaattcagtcctcaccactctttgatatgggaactatcattacctcagtcagacagaatagaaatggaagcacagacgagctgagaaagttgcccaagttcacacagcttagtaagaggtagaaattggatttgaacttgaatgcaactgaattccagttgaattccaatgttgaattccaatgtccagttgaattccaattccaatgcccaggtaaattccaactccagttcagttcccaagtcgaagctcttccacactttgtgtgagaagtcatgttatttaacagaaataatcttttcaggttttatttctgtctctcttcaaatcttggctacatcttgaattcactgataacccagaaagctcttgtgtcagacattagtgctgtctatgtatgcatgaaggtgtgggcctcctcactaaccattctggatttcagtttcctaataaaaatataatctcctaatgtcatcaagtctgcaatggggacagaaaaattaagtttcagaagtgttaaatttgaaaaaaaaaaattccctcgatatcaccaaggaaattctggaccatatattgagaaaattttgttctccttagtcagaagttagaaaacttgcatccatctcaaagcccctttgcctctgatgcagtttactgtctcttaagctgcctgtgacactgaactggcaagggtctgttccatttggcctcccgaagggcttaatattggaaatgaggtgaagtctggtgtccgttttcaaagtgtctcagattaaaagagaaccaaattttatatgccaaaccatcattaaacacaaaacagtacacatgttttaggtgcttttcaattctaaacattatgcaagtaaaatgttatggaatataagaggttaatggaataagacaacatcaaaggaaaaagaacacttgaaaatcttttagagcaaacttcttactccgagtgggggtgggaggcggatttgaagaaaggccacctaacaaagatgggaataaaggatatttattgtactccacatcaaacatagaatatatcaagaggtatcaaaaaagagacacagggccagacctagcggctcatgcctgtaatcccagcactttgagaggccaagtgggcagatcatttgaggtcatgagttcgagaccagcttggccaacatggtgaaaccccgtctctaccaaaaatacaaaaatcagccaggcatggtggcatgcatctgtaatcccagctactcgggaggctgaggcagcagaattacttgaacagtgagccaagatcactccactgcactccagcctgggtgacacaggaggacaccatctcaaaaaaaaaaaaaaaaaaaaaaagacacaatagcaaaaaagatgataatgaagataaggataacaatatcattggctaatatttatggaatgtctactacatgccaagtattgggctaaaaactttacatacatcccctacctggaatccacgcaacatccctaggaagtaggtactattcttatccccaacttaaagataaggaaatggaggtaaaggcaggctaagtaagtgtcttacccaaggagatacaataagtgtggcactgggattcaaactcagagccagtggtaatactgcctcccaggtaagcaaatagaaaattgcctttgaggccaggggtggtggctcacacctgtagtccaagcacattgggaggctgaggtgggaggatcacttgagcccaggagtccgagaccagcctgggcaaaacagtgagacccccatctctatcaaaaaaaaaaaaaaaacacataaatttgtctttgaattaagaggagtgggggaagtgtcctctattctgtgcacacaacagagagcaacatggaaagctgtaggaagctacttatttagggagccagttgtacttattgcccaaatgaacaccactctctgttaaaggagtcagtaagttgaatccctagcaactggggaatgacaacatcacgaaagtttaaaagaaattttttttgtttgtttcctttaaaatctttacttggctgcattctaagctgagctttgtctggtaacaatgaaatttgctcctaagtttggagccaagtccaataaaaatcaaaccaccttgcatgatgacccccagtgaagtgatagcatgaaaactttggtttaaatcttgagtctgctactgaatagccagatgatactgggaaggtcacttacattataggactgaaattttctcatctgtcaaactagcataacaataccttctttagaaggtcactgttaattgaaataatgtgtgtgaaatggtttgcacaatgtctggtataattaccaatgaatcactaagtgtgcacacagaaaataatttgaggtttaatgttaatttaatatgctaggactttaaaatgatgtggaagtcacacgaaggaaaatcacgaactttatcatgtgttccctgggggaatgagccttaatgctgaaaagaacaatttatattgagaaggtagaatgaggtgatgattataattaactgattttggctcaaaatcactttaaaacccttccttttgggttctagagaatgttacagttctctttataaatatcactgttgacttttaataaggacgcgatggaccaaatagcaatacatcagtacaggaacaaaacttcctgcatttgctattcagagaaaaccaaatgatctggtaaaatgttgctattttaacagtccagtttgactgtttaaaatgtttagttgctctgttctccaacacagtgtataagcactgagattccagttactggtaaccaaattgtaacactgactgaacaactgaattcttcagaccagttcttctgaaatgttaatacgcatctcaattatctagggatttggttaaaatgctcattctgattcagtaggactgggatgagtccttacattctgcatgtctaaaaagctcccaggtgatgctaatgctgttggtccctggaccacagctgggaggagcaaggctatggaacacaagttctctccctctctctctctttttaatccagctttgacttgttcatccgttcacaagccatcttctgccctcccatctcagaggaagtttctgtccaatgtcaaaacgaagtgaaataagtgcaaagcacaatattgtgtccagtctaaatctgagggttttcttgccctgtattttgacatatccacatgagcatgcaataatgcacaataaatactagaaatcaactagaacttatatccacaccttctttacttgtggattaatgacagttgcttcctttttatgcacttcttgccggctcctcttgtacgataaatgccaacaacagccaggtaagtcctatttttattcctattttatagaagaaaaggggagattcagtcagactaaataatttcaccaaggtcacccagataggaagtacagagccagtctgactctcaagtccatgttcttaaccactgtgttatgaagtacagttacccgagaacttccagttctgtttctggaggaaaaaaaaatgacatgaaaatgaggcaggaataaaacagggtgatcacaggagaatggaaaattccagggagtaatttcacataactagcaaaaaagagactactgaaatagctacaaaagctatgagttgataagaccctgaaaaacaggcatggaccaagctggctaataccaactggacccaacatggtgctgcatttgacctaggtttcacctagaacctcattatatgctcattaacatactaaaccacacactcaccagtgccaggacggttccaaaaacactcatatttggtgtaaaactggaaggcaacatagttcagagaaatctccacctttttccaggagttttcatgaatatcccaccccttggttaaagaaacccataaagatggaaaccgcaaaccccacggcatgactttctcctgagtaaacccgtactcccctttcttaagtatgtatttttcactttgcaataaatcttgctacttgaactattttctgcctcatccttgaattccttcttgcaatggggccaagagcctggatatcagctggaactgaagtcccaccggcgtttggggacctcctccaaaccaaaaccactctctgtgtcacagtgatgttggcctgggttctacatttctcaacccccaatctccaaatgagtggatggcaaaggtttccagagtttggttacaatctctctgtgctaaatcaagatcatagtttatgacccacccagaaccatactgacaagacacaaattacaagttggccacatagaaagcactcaaccatttaatctacctggtatttacaaaatgatttcgttatgccaattgttacatgttgtggggcaaatacaaaaaaagagaaggcataatttcagcttcaaagaaagtccaactttcttagaggtaaaggtaaagttcattgtggtgaacttttaccatagtgaggtaaaagttcattgacttgttgattcattcattccacaaatattcactaagtgagtgtctcatgtcatgcactctctaaggcactaacgccatgaaggtgaacatggtaaacgggcttcgccctctctgagtttatagtcaaaaaggacagatagacattaaatgcataattatacaaataatcacaatagtggtgaacactacaagggtgaagtacaagatgttctgtgaaacttgaccttgtctaggggcacagacaatacatcctaggaaactcagacaagtttaagataaacaaacatggacattgattagtcttctacagggaggtctagttacacaaagtgatggtcctctgacaactctgaaatcaacgcattcaatgcaaacaaagattattattgtcttctggaaaagtttccagatctcattagggaaaaatgaacccaatatttgttcttaacatataattacttcaaactatggttaaactcacagaaagctggaaagtcagaaagttttctgacatctgtcttctaatgatgcttttcactttcagattaaacaaattctgctataatgaaagaagatgaagagggaccatcatctctatgggaggccaccatgtctcgccttccataataagctattacaatactttggacccatatccataatgccaaaggaccaattattactagaatcttaattctgggaacaagataggtaaagaaaaatgcatcacgttcaagcaaaaatacactcatcaaactgacacctcacaggcacatcaaacaaaacactaaactacaccccaggattccaagatgaatactaattttctaaagtaaattaggtaaccttcaggacacagaaccatctttcctgacatcagtttagagctctaaaaaataaaaaacaaattgaaaagcccccaatgtatattcttacacatatttgctcacaggatggtgtataactagattaattgtgagtatatgtcccctgggggtagaattagcctttttggatccctagtctaaaatctagaactagtggggagaaaagcaaatgtcaggcaaaacccccattatcatatgtaaattacagaatgagtgatttcctgtcaacaaaatgaattctgtatgttgttttggaagtggcaccttattaaacacacaagtcattttcataattaaacaagggcaaatgcagaggaaagaagccatttaaaatggcatcttggttttcagagggaaaaaagtgggtccaaataaaccacagcaacatatgaataaccatcaagccctgctgtatggttaaagtctgagactatcgtcaagatgtttgcattggaatcctggctttgcttcttctaaaccagacaccttgagcaagccacttcttgtttctaagcctcagtttcctcatttgaaaacagaggataaacttactgtgatgggaagcatatgaaattcatagcatgacacctggcactagtgttacctgtttttagtattcttaaaatcatctttgtatttctttttttgttgttttgtttttttctgttttttttttttttttttttgagatggagtctcgctctgttgcccagactggagtgcagtggcgagatcatggctcactgcaagctctgcctcctgggttcatgccattctcctgcctcagcctcccgagtagctgggatgacaggtgcccgccaccatgcccggctaaatttttgtatttttagtagagacggggtttcaccatgttagccaggatggtctcgatctcctgacctcgtgatccacctgcctcagcctcccaaagtgctgggattacaggcatgagccaccatgcccagcctcatctttgtatttctttattattgctgccaagaaaaaaacagaggaattaccaagaactttcacaagttcaggatggaggctgaagtggaataaaccacaaggtgaatgaaaggagaaaaaaataaaaataatcagaacactgggtacactctgtgccctctctctccttcaattaacaagtaagccatactcagtccatgcagaagccaaattgtttacatatgacattcaaatgagcagcctggcctgggtttaaatgaaaatgtactcatctaaattagggagcagcaaactttccataaaatgccagacagtaattattttaggctttgcagaccatacggtctctgtagcaactacttgattctgccactttgtgtgaatgcagctatggacaatatgcaaccaaatggccatggccgcgttccagtaaaactgtattgggacaggtgtggtttaccaatcactgatctaaatagaagtttgagaggtcagtatgacagatatgtttgtttgtttgtatgttctaatgatgtttctcttttttattgtatcaatttaagttgtgcaatatgatgttttgatatgcatataagtactgattattatagtcaaacaaattaacatagccatcatctcacatagtcacctctttttttgtgtcaacagtacctaaaatcccctcttagcaaatttccagtatacgatattattaactatagtcctcatactatacattagatttctagacttatttaccacacataactacaactttacacattatgacctacatctctattctgccccaactccctgcccctggtaatcactattctgctggtagacaggttttgttcattgttttcctaaccaatgtttctgtccacttcctgaagttccaccttcagttgtgagcagggcatggatggtagaccagagacgggtgctggaggagccaagaagaccctgtttcaaaggaggtacacctacccatgcctagcacatactgggaattcaatacatatgtccacgatgttttatttcttgaaaagggaactaaagggtaacaaagtgagattgaaaataatatacaaatataaatttaacatagtaaaatgtcaacatgtgtgaagcctgggaagtggaaacgcaaatgttggttatctgtgcttctgagactaccagggtttttaatttccatattgctacagaaggatatttatgtatatttagcagaaacatcacagcattggtcaattgctacaaaaacgtctaaagttttactctcattttctgttcttgccttcctctggactgataatggttttaccgtggtaccagtccacagaccacactttgggcactgcttatattattttttccttatgtttgaaatatagcacaattaacatcttaaaaataaaatcagaacggagaagaggagtcaaatgtggaatcctaaaattcaaaggtcatgaaaccaactgcagaaacgccaaactaaagggctttgtgtctttacagattacttcattcaagaggtatctattgagggcccactgggtatccattcctgtgccagggttcaggacagtgagcaagccacagtggcagcccttggggagccttcagttagtggggaacttttcagccttgacactaccgacatttggggctgccttgttcttccttgtcaaggttccttgtgcactgtaagatgttcagcagtatctttgacctaaacccactaggtcagtagtcagtagtagtacctccccgagttgtgatggccaaaaatgtctccagacattgccagatgtcccctagggatcaaaagcaaccccactgtgaaccactgacctatagcaaaggaatgatagttacagttaataacaactataatatgtcaagtcgtgttgacagatagggctttaacccaaaaatgttaaatcctcatgaagaaataatatgttcattatgaaacatatatctcaactaagtgatacttatgatcattacaaatggtaggctacattcatactgctccatgccattgcaacagttcccaactactattgcaatgggcttcagtgctgaacaaattgtcacctaggatatttcacagaatgctcataacaggttcgccaagaaattattacagtatgtatttcatgaaaaacaaaacaagagatccagaaaaaataagccacttgcataacgtggcccaggtagacactatactcaggtttactgtctctgagtctagtaacatcattactaccaccaataacaataaaggctaatagcgcttattcagagaatatgtatatgtataagctattgttctcagatcataatctcatttaatgctcgtaacaaccctacaaggtagcttctgatattgccacattttacagacgaaaaaactctggccaagataaattaaataacttatccaagtggcaaaggggaggaatttgaactcgaccacaccagtggtttctcattccagtttctgtggagaaaaatagtcaatcttcactattaacagattccatatttgcatatttgcctactcactgaattttatttgaaacctcaaaatcaatactcacagcactttcacgacattttatgggcatgtacagagcagtgaaaaattgtagttgcccaatgagtatgtttccagtggagatcaaacaagaccatggcctgtccttctgtttcaggtctcacactgtgaacaaatgtgctttttacagtctatttagtgccattctttcacatttttgtgctttttgatggtaatttctctgtttaaaatgacctccaattgtagtgctgaagtctatatagtgtttctaagtgcaagaaggctgtatatggcctatatttttgcttccaagcaacaactgccctaaaccattaaaaaaattcaaacatcttccatgtggtcttgaaaaagtaaccccacccaaaattctagccagaagtctacctgctgaggcagaagagcctttgagtactaatcatagatacactgactcatgctatcaatctaaagcaagtgttcacccttgactccctgtcacactcagcaaatttcctacctctttaaaacttaccagccttacagagaaaatggtgtgctggatatgcttcattcaggcatgagttacagggctcttagctgtgaattcggtgttaatgaatccacaataatatatgtccagaaaaagaaaacggaaattggctgatctgaggccaagccacagattgccaaggtaacatctatagtgcatgatgaggctatggaaaagatggaaaacaggctaaatttgtggatttgtgagaagaaaaatttgaaaaaacatagtgaacagcattgctgtaaaggatcaggaaagtgttcaacccttctcagtgacatcttattataaagaaatactgcatatgtgatttgaaagaaatgaacattaaagtgtcattaaacagaaatacaagtaagatacaattatgtattgatcagttgatgaaaatgtgaccagaagttcacaggaacctaatcctgtatttcccttagcagatcagtatttgctaattaagtgttcatggtgaccttatacaacataactacacacagacacaaaaacaagaactgacagtatgtggatcactcttggaacatttcctgggctttcccctcaaagttcctaaatttcaacagcggggcccagaaatctaaatgttttaaaggctcctcatccacagacccatgtttatgaaccactgtgatacatcatgctaacaaaaccaacaaaaatctttaaaaaaactattcttcctacttttgataaatctgtataccatagagcgccttacagttacagagggctcatgctgtgaaattgtttggcttatatccttgcttccaggccacaacttttttaaaccattaaggaaaaaaaaattcaaacactttccatatggtcactgaaaaagtaactccacccagaactctagccagaagtctacctgctgagttaggagcccttcagtactaatcacagatacactgactcatgttgatcagtccagagcagggattcaccatcaactccctgttactctcggcaaatttcccacctctttaaaactttccatgtgtgtgtgtgcattcacaatgtactattatcttagtagccagggcactgtacaaagagcattaaaagataatcagagatactataaatagtgatttggaaatatacttccttaagagaatgatgacaagactcatgctcaggatagatttttatggccatccccagatgtccaacaatctttctctccagtatagaattctccaaaggctattccactgaacacaagtcagagagaatgctttgagactaaaaaattccaaggcaggtgagtttggaaaatgctgcttattataaaaccttatagacattcaatcacatattagcatagtaaaagctctgagaagccctgaagggaagataggaatgacacatgtctaaactatgtttcagtgagcaattcccaaactgatttgaccatgcgtttcctttacaaacctataagttccaggaaacaatgctgagaagtgttattttattatcctgctggtggaggccatagaaaaagatgaaacaacctccccctcatggccatctccacattctgatgaaaattccttacccttatttctccagtgcaaggattcatcacagatcaatcacggagacagctttggactcttccagaaattccacagctgcaccctttgctcatgaccacaggcaaggtccaccattagggggagatgagcgctgcgcttcaataccctttcctccatgaaaacatccatcccaaactagatgaagccttcagacatacctacaattatcccactgggaaagatgagcatgagaaaaacaatggtctcctgcaagataaacagcagtgtcctatttgttcgcagtgagtgaaaatggcattccttctgcccggaatgagaacagaggaaaaaaggtgttcaaattatagacactttcattttcaaaaatcatttatctaaattatttgatgccatgaggaaggctcccatgaagaaggggcaatgggctaggccttcagggacaattcaaaattgggaaagtaggactacagtatgtgggtatcagagatgggtggaccagcatgggaggggaggtttcaaaatgatttaaatagcatgaacgaatataatacagaacacagtttggttcatcagaattccacggtggccgattcctgggagaaaagcagccagaaggtaaaacttaattatactttccaaggccatcagagatgctaccgcatgagaagtgtgatgtgtgttttgcacagactggggaaggaatgcctgcgtgtgtgggacaagtgagagcaccaggaggaatgactgtgttctcaggatgaattctatactcttaaagaagaaaccaattgaattttattttattattttatgagacaggatctcattttttcacccgggctggtgcacagtggtgcaatcatggctccgtgcagcctcaacctcctgggctcaagtgatcctccctcctcagcctcctgagtagctaggactacaccaacacactcagctaatatttgcattttttgtagcaatggtgttctgccatgttgcccaggctggtctcgaactcctgggcacaagtaatccacccaccttggcctcccaaagtgctgggattacaggcatgacccaccgcacccagccaagaagaaaccaattttttttaacactcccacctgcagctggacatgtgtatggcacagtgcaagggattttcatcaagtatagctacgtactaagagtttgctccctgtgtaatgtttctgttaatttaatgaaaacgtaaattagtaacatcaggtttttctgagagataatagtataatgttgagattcagaccatgaactccaaacccaggctgcttaggttctcatcctaactctgtcactaacaggccatgtgaccttgggctaggcatttaaactctttgtgcctcagtttttccatctgcaagatggggatgacaataataccactacaccagaagggttgacgtgaggtttaaatgaacgaatacacttaataaggcacttagcatagtacctggcacacaagtgctattaaatagttgtgcactggagtaagcttatactggctcatgagagtcaaatgttagcacctcttcctaccttcgtactcagagacatcagtcatcccctgccagagccaggtgttaaacatttatcagcataccacataaacatcatattttcaaaaagtttgtgtaaaaatggaattaaaagataaaaattaaaaatataaactttatttctcaacgcaagctccaaccagttcaaaactctcttgtgagtgatgaaccagccatttagtccttttttttcttttttttttttttttttttttgacacggagtctcactctgtcgcccaggctggagtgcagtggtgcaatctcagctcactgcaacctctgccccctaggttcaattgattctgctgcctcagcctcctaagtagctggggttacaggcgtgctgtaatttttgtacttttagtagagacggggtttcaccatcttggccaggttggtcttgaactcctgaccttgtgatccacctgcctcgacctcccaaagagctgggattacaggtgtgagccactgtgcccagccgccatttagtccattcttaaagaactgaaggtcctgggaatttaaccatgtcaatgttgtctttttttacattatctttatttatttgtttattttcttgagatggagtctcgctctgttgcccaggctggagtgcagtgcaggggcacaatctcggctcactgcaacctccacctcccaggttcaagcaattctctacctcagcctcctgagtagctgggattacaggtgcctgccaccaagcctggctaatttttgtatttttagtagagacagggtttcaccatcttggccaggctggacttgaaatcctgaccctgtgagccattgcacccagccttttttacatttttaactgaagaaaaaaatgggtgtcccttacagactttttaagattagaaaacaaaaagaagtcacaaggagccaaatcaggactgtaaagttgactcatgatttcccattgaaactcttgcaaaattgctcttgtttgatgagaggaatgagcaggaaggaacactgtcatggtggagaaggactctttggtcaagttttccctggcatttttctgttaaagctttgattaactttctcaaagcactctcataataagcagatgttatcatcctttggtcctccagaaagtcgacaagcagaatgtcttgaagagtccaaataactgttgtcaagacctttgctctcgaccagtctgcttttgctttgactaaaccacttccaccgcttagtagccattgctttgattgtgttttgtcttcgggattctactgataaagccatgtttcatttcctgttacaattcttcaaagaaatgcttcaggatcttgatcccacttgtttaaaattgcagttgaaagctctgctcttgtctgcagctgatctaggtgcaatggttttggcacctatccagtggaaagtttgctcaactttagtttttcagccagaattgtgtaagctgaaccaattgagatgcctatggtgttggttattatttgtgctgttgtcggtccctttcaattagagcacaaacaagatcaatttttttccttgcaaattgatgtggatggtctgccactgtgggcttcatcttcaacatcatctcatcttttcttaaaatgaattatccatttgtaaactgtggatttctctgagccattgcccccataaacttttggtaaagcatcagtgatttcaccacaaatttgatatttgttcttgtttcgattttagcagaattcatgttgctcgattagaagttcttttcaaactgatgtctcatcattcttagtacctgaaactagatcctgttcagctactttataacaagttagtatgagtttcttgtggggaaaaaacattgaaatccatgtatagttgtatcctattgtgtactttccaggaactttttgaagactcctcatatatatgcatatacatacatatgtatacatacacacatatataacacatatgccatgtgtgtatatatatatatacacataagtgcttggcttcattattgccaacattgaagttttttttaatatggctcaagcagaatctgagttatttgaattcctggcttttatgtaggtttcatgaaaatttagaggttgctctcaaatcctcaaccccaaaataattatttatagagtaccatcaatatgtctgacatagccatagacattatggactacagaagaattataacaaaggtctttacctgcaatgagtttacaatcttgctaagattttttgcaaagctaatgaaccacatagttggtacgtgtttctttctctgggatcatgtttggtacccatggagcttatccactgttcatctcttccccgggaacctcagtggtctccatagttaatgcagataaatatagcccttgccctgaaactgggcaaatttgctacttatcactcttactagatataaacagaaaaatagccaaggtaaacaggcacatatacaaccacattcatattctttaattaagtaaaaaccaacaagcatgtattaagcctctagaatgtaccaaagtgctttatgtaactttctcctgttgggagctattcattcactgtttttagctgttttatgatgtaaaataactgaaactcatgaattgtaatgatgttaatatttatcataatacctaatgcttattgagaatgtagaatcagccatgcaattcttctaagcactttacattactcctcaccacaaccctgtgaagtaaaactgttaatatccccattttacagatgagacaactgagcttcaagagactgattatgttgcctagtactacagagctggtaagagctaaaatttgaaccgggatttggcactctagagccaatgctatgaatcactgtaaagcaggtgtttctcaatcttggcactactggcatttggggctggataaatctttgctctgcattgctatgcactgtaggatgtgcagcagtatcctcggctcttactgactagataccaggagcaatcgacatttgtgacaattaaaaatgtctcccataggaaccaactcacccaaatgagctggccaaatgccccctgcaattcaaaactgccaccggttgaaaaccactgctataaattaaaagaaagaaagtagggaattcctaaacctggctacatattagaaatgcctagggtatatttttaatgggttaaaaatgcagatagcaagtcttatcactgattcagagaatcagagtgtcaaggggtcccatagaatagtccatcatttgtcaccaattagttatgtcatcttgagaaagttacttgccctctctgtgcctcaatttctttatctagctactgagtgggcaaagctagactgtgtgtcaaacctttccatggctaacaatccagtctgtgaaatcactcagatacccatcacttccctccttgacaggcttctattcacactgcacagagagggtgtaatgaccaaaaaaagttcctacaactccaatcctcataaggaaatcctcataaggaaatctggccaaaagctgacccgtgatagacttacaatcagttcaccatagatacaaaattgggcacaattatcactacaaaaaggttagtttccacttcacacacctgaggtaggtaaaaactgaatcccaaattggagatgcaattttcccattatgcaaagtggttgctgcattcctgggtggaaaaaaaaatccccaaaccagtattgccaaaactgaatttactagaaaccttgactccaaatgacactggggagtgtgctcctcttttcagattcatgaaatgctttcatgtcatttaagaagcaaaatgcaaaagaaaaaagtgggcattgtctacacttcagacatggaggctttagtctgacaatcccagatcctatctccaactcaaaacaaatctgttccatggcaagaaagtactttagagaattagtctttgctgtatttgtatatgctaattaagctccaaaggagaaactgctgatgataaatcgctgacaaagaagccatttttaaaaaattttactaatttatagatatatcagattatatcggtttaggtcacacttactttatatacccatgtgtaaaaataggatgaaaatgattacatttgaaagtgcctggggttgttaaagtaaaaataggaacaatcttcattgaagagggggaaaaacatccttaaaaggatactgaatagaagggtgtctgtaaggcacggagaagaaggagaaaatgtcctggattatgaaaccacaatagaattctgctcagaaattgcatgttatcaattcagttgatcagataccaataaatccatttactagaaactgatttcggaggaaacagacttgtaactataattcaaattcattcctttaaagcacgtactaccagtgcactctatcaagggtgggccctaaccactattaaagtgttaaaagaaattatttcaattctttatgagtataaaattatagtagaagggaatcaattaatcttaggtgatatgccaccaggccataatcaagtatgataaattgctttcttctatcctagtttctcaatgtatgtgttatgacaggttctgcgaaggtgagtattaaaaaatatttgttcccaactcaaaagggcatcacataaatgaccgccagcgccatctgtcggtggtacacagagctgttgcacttgtgcctgggcttgcgagtttttgttcacctaaattaagattcgatgactgaagttttacatgagggacagcatccgtacactactctaagtggtgtagtgcagaagctcttaaacatttctcctaatgtttatacccttttacatggccagacactgaatgaatttcttctaatgatctggaggtgaagcctaaaataactgcctcaaatttcctgatgtcttagtttatcttaaacttttatatgaatcttgtgctgtataccagagtaacctgtgtctgtttttttacgtaaaaacatgtataaaatatttatagttcaactacttaacttgtatgaccaaatattcgggttaaatagataatttgttgaggtgtaccatatttagcccctggggcatattaccttggatacctacatcctccagagatactcctactccaatttgagaaaaagtaggaactcagctctgccacagcctgctgtgtgcccacactgagcctcagtttcgttatctgtgaggtaaggaccatggacaggatctctaagggtgcttccagctctgacattctctgaaacaacagtcatttggatcttcagacacaaacacctcactcatctcactactggtgagccctgcgtgcacattcctataacatgtgggcacagagatttgtaaattatattattgtatgtctagttcaataaatattataaataggcgtttcctatttcacctatagtcctaaaagcttatctactcaagttggcaaaacaaaagcattttctccctcattcttctcattagctaaatggaggaatgccttctattagagtcacctcgtatttaagcatacacagctgggcgtgtggcatgtgcctgtagtcccagctactccggaggctgaggttggagactctcttgggcccaggggttcaggaccagcctggggaacacagcgagactccatctcaaaaaatactaataatttaagcttatacgacagctcaataaggttaggtctagtgttcaagaatgcaacaggagatgacattaaagatataagcaatgaccataacaaaagagctcttaaaaatgatgttaagtagctaagatttctgcatgttatggcctgtggattttggatgttggacaagcccaacaagacaatacacaagcacagagaagccgatctcagccctatcagcatgagacctttggttaagattcttgccaaagctgaagaattcaagccctcaaatgtattttcaagaaccagtcattttatttctcccctaggatcacagaccttcccaagcccatgaggtgcctgtgaaactccacatatgggaactatatttttaggaaaggggccaaggtgtcagaggctatgcatcacaagaacaaccccttctttctcttttactaactaacacagtttggctttccctcgtttctagcagcagttaattccaaggctttatgttctcagacagtttcaacactgcctttcccttcagagtcatcaccaaaataaattttaaaaaattccagtgcgcccttcactttttcagtattcccactcctgctggccccaggtgttctctggtttgaaggttgcccactatgcaacccgctgtataattcagaacctggtgcacttcccaggcacatcagtagtctaaatttgtactacagcaaaagcttcaagggcttaatcaattacagatcaaatatttaaaaatgaggattaatctcatcactgcagcccaacagatgcattttgtgttaataaatacacttcaaacttcctgtagacactgaaaaatgcattcccaatttgcctttgctcctggttcccaacagacaggagagagggctccattgatattccagagctgcactttccaagtgttcatggggctggctctgctgtatctcgtaagataaaggaatcagaaattagaggaggagaaacattctgaccagatgctctctgatctccccaacaaaacttcaaccacactgtcagtctcaatcacaatgtgtgggcactgagattcatgaggccaaatgaaaataaaattatgatattcatttacgtgggtgatggaagggtggatgaaaagctccatatgttcggagtttcaagtataatttgaaacagcaacatatcagccttaaaaacagaacctccatggcctccaaatttcaagaatagtagaagatgcttgcctagaataaatcaatttggaaagctgcagtcatcaatctcaaagtaatttctgccaaagtataaatggtgatttaaaaacgggggaaatgccagaaaaataccacttgaaagttttattaatagtacattacagaacacagaaaaaattatttattagagaacttgtgaagaatacacagagaaaaactcacatgaattcacaaaacggggcagcacaatgaattcaccagtgtattaaaagcagaacaaaaaaataaacccatcacagaccaagtaggtcttaattcaaaaattcaaggagccatctaatgaggtggctcattacagtgtcacagcggcacatgtacctctagtttatgaatttcaacgatgtaagctaaaaacaagacaaaatcaaacaacaacaataacaaaactgataacaattgtctttgataatagatggctctagaacacaagccaaccacttcatatgggttcaaccaaagaaacaacattctgttccaatactggaaaaaaacaattgggctgagctgctcttactgagaaatgctagagcacaaacagggatgatttaatggattttcaaagataattatggcaggactcaattttcaccttgtttgacgactttaagctaccctatatatgtcaatagtttggaggagaaaaaccacatggttatctcagcaaagaatgtaaagaaagcatgtgataaattgagttcatatttttgacaagcttgtagtaaaagcacaaaggctatttgtagcattatgtttaacagtaaattttggaaaaacccaaatatacatctatatgggcacaattacaaaattatggtgtttctctatacagagaaactctacataaccattaaaaagaaatgagacttacgcactcacacatgacaatgatgaggatagatgcaaactgaaggacaggatgaaaaccttaatcacattttcaaaaaagccatgacatgtacacacacgtgtctctatttaaacagcatgaaaatacatagagcaaataatcatgactgcaataatcacggttagttccaagaaaagtaattggagcagaggcttttggtttataaatttctgaatcctcagattttttttaaaaaacgtacttcttttgttaatttaaaaaataaatctggagaataaggaagaaaaacactccaattaaaaatgcagaattggaccaggccagaaaggtcatctaggaaaagctgtgtccagcatctccatcaaaggagaaactactcctttttattcatactcaggaaggaggtggcagagttcctggctaatccggtcaattgttacacaagctaagcagtgcaaaaaattctacattttatctacccccttcttctcattctcaactccaagcccaatccttttgttcttttctcaggagctttagaaaacagatggttacaccatcctttgaatctgtcaatgaatcacacaaaatcaacagtgtttttctggagggacactattgtgttcaacaatacagaacgacatatcccagtttgctccccacatacaaacataccagattccattaccaatgagctattcaaagggattttaccagatgtacttaatttaattcaacaattattaattcaatgactcccgtgctcttggtattttattatgagctgtgcaggacccttcggaaatttaaaattttatggtggagagggacatacacgatgagaaagagataaacaattcagggtagtttaagattaggagaacgtgcagacattatagtttttgaagcactaggaaaatctttagagttcagactaggctaaataaggtgaggagataaacatttaggattttttttaacttttcattttctatttttaaacgttattttgtattgtttgtttgtttacttaaaaatattttgggaggggatttttactattggccagctagggtcaaggcaggggtatagagcaaggtggagatgggaagactaagaggcttctgcagtcactaaggcacaaacgccaaaggctgggttgagggtaggagcacagtcatatcgaagacttgacctggctcaatgacacaccggcaaggtttggatctcagtgaccaaaggggattttcatgtaactgacagatgcaatgaagaaaaacactgagcagagtgcttaaggtatcagagaagaatctcagcatgtggaaacaggaaggtagttaaaagtcaacactggacccagacttatgatttaagagagagaatcatcactttgtgttccttcactctccacacctcacagctttctgcagttagtatgggagtttggtgggaacctctgcactttctcccactctttcgtatccacgtcaaaggtcaaactcttcatatgccaaaagaggcaccttggccgaaccccaatccacaaaggaatgcactaaatcactggaagtgctgcacatgaagacaaaaatccaacaccatattaatcattggcaggttgtatttcctgtcccttgaaaagttagccacttcactgttcacaaaagcaaagacttggaaccaacccaaatgcccatcagtgatagactggataaagacaatgtggcacatatacaccatggaatgctatgcagccatacaaaaggatgagttcatgtcctttgcagggacatggatgaagctggaagccatcattttcagctaattaacacaggaacagaaaaccaaacaccgcatgttctcgctcataagtgggagttgaacaatgagaacacatggatacaggtggggaacatcacacaccagggaccgtcagaggatggggagctaggggagggatagcattaggagaaatacctaatgtagatgacgggttgatgggtacagcaaaccaccatggcatatgtatacctatgtaacaaacctgtatgttctgcacatggatcccataacttaaagtataatgataaaaaaagaaaacctttaaaaaataaaataaaaaggtaaaaaaaaaattagctgcttatacagcaaagtgagagtagttttgcatttttcttaagtatctactctgcaaaccaagaaattaaatcaagctttgttgctaacaaaacaaaagagctacttggtatcaagtaaaaacataatgggattaagggaaacgtacatacagatgtccactggccctgagtggagggaacagatcatgtcagggaataggtaactggcacttcctcaagtccatgccacactcctggaagcatactcatatctggttaactgacactaacccacagcttgcctcactgagagcaggaagcccagagccgtcctttcttctctttccttttgctcatcagcactgctcttttcaaattttgtcagcctgttgtgttcacgctccttgaacaagaaaactgtcatttggcgtgacatctctctcctaccctggaactcaacaggctcctgaaaacctgcaaaattccagacatacttattctgtgaattttgaaaatctcttactcattttaatgtatccttctatgatggtgattttctatccgcattgacacccaaataaataattaagaatcatcccatcttccaacttgaataatgggcgtaaatagtgacagaatccttttttacttccgtgttccacttattcaggttttcctcctcaatcatgttgtttaatttctcgtcagctaagcatatctttggacagacaaagcaattttcccctacagtgtgtcaattctgcagtgaaggttttctgtttacctgcctacttccttagctcaaaaaaaaacaaaataaaataaaagtctcatactcaactgtcacacatacgcttcattttcattgtgtttgatatatgaattccatacagtgagacaggtcttaaaatccagcactcagcgactacttcatctcaggaccacccttttacagacagccatggtgataagagctatagctgacatttcctaaggattctttgataaatttcatcacttccttaactgcattcctattgcttaatcaagatgcccctggggccgggcacggtggctcacatctgtaatcccagcactttgggaggctgaggcacaagaattcattgaacccagaaggcagaagttgcagtgagccaagatcatgccactgcactccagcctaggtgacagagcaagactctgtctccggaaaaaaaaaataaaaaagcccatggaaagaaaggctatcaagaagaaaggagaacggcagtccagggcacagaaacacagaaccagatacagggagcatcctcaggaggttctgcacgctgcctgtgactcaaggcccacgactcttggtcggcggttttcaaacccactgttttccaacaggggtggggggaaatgtcaccaaaaattgtgttaataattgttgctggtttgcaaattatttttatttttcctataaactagaataaatccagggcatgtttatttaaaacagtactctcggtcttgcatgccaatatggcctagtttccatgaagctggcttgggtggtagcaaagactaggactactgtaggaccaggatatggccaaataactcgtatttcaggcttacttcttaagtgggatgaaggcatacagggtccttgcttagagggtagaaagattagttctctctctctttgatcccaaagctttttcccttctaagtatggggacaagaaagctcagacagcatcctatagacaaaggccttaccgctctcactttttcctttgtacattttctattcttccatgacattaggtagtatgggtctagcatctcccttggattccagtgccctacccatcctcacctcagcctagacccatcaagggacagcagccctcagcaggtcttcgacaagctatacggcaccatctctggcaggtcattcatttcttccttttgatctgtctctgatttgaatatgataagactatggtgaccataccatttatcattcaaacaggagagctcttgtgaaggagagcttattgactgatcaattgattgatgtattaatttaaagacagtctcttgctctgttgcccaggctggggagcagtggtgcatcacagctcacagaatctcaacctcctgggctcaagtgatcctcctgcctcagtctcctgaggagctgggactacaagcacacaccaccgcacctggttaatttttcttttctaatttttagtagagacaaggtcttgctatgttgtccaggctggtcttgaactcctgaactcaagtgatcttccggcctcagacttccaaagtgctaggattgcaggagtgagcctcaacacccggcctgagccaccacacccagccagcacttcaaataatataataatgatatgatatgatatgatatgatatgatatgatatactttaataattattaaaatcataataatgatagcaattatgggacaaccaggcacacatactagaattatcctcccaggcaagtcgagaaaatatagtgtgagtttttcttgtaatgggacggaaagattcagtattttagtttcggagttgggaagatgaagaattgattttggcctactttagattttaagccattctggcaaaggagttctccataggtccacagatccagacctatttaatcaatatctatagtggggcttagggacaaagcacctacattcttgtattttgatttatcatctgtgcattagtgtctcagggactttgaaaacagggcttaggtactattttgtctattggctaaaatgccattatatttacttaagcgcaaccacttcattatttataacaccaagaataattctaaatcctttctccctgaatttattccctctctcttccaaagacctgggtctcatttatagaccacaatctacaaacatctgccccaaataagctacgcccataattccatttctcacgagagtccctggaaagtaacaaagcacctaaatgacactgaaagataaaatccttattttatcctatcattattttagaacgtgagttatatcatttttttactctaaatgaaccacccaaacatttttaagaaaaaagcacttcatatgtttatatatccaaccgggacagacattacaatttacactatcattttgctgtcacactgtttagaaacattttccatagaagataacccctgaaaactttctgtataaataaatactagcagaccctctgcacttctatttatgttcaagtttactgagactcagtgcaaagctatcttgcttttaaacaaagcactcatagataacaagtactttccatatcttcatccccattctcaatcatacagctaaatttgaacaaaatgaaaagaacttaagaattagatgcccaagtgagtagatgataccaaagcagaacaagttcacagcaagatgtttaataagagttttggctttttttgtttttttgttgtttttttattaattaaaagatgaggtctcgataggttgcccaggctggtcttgaacttgtgacttcaagctatcctcccacctcagcctcctgcatagctaggattacacacacatgctactttgtccagctgagtttggcaggtttaagggggcaaaaataacatcattcacatccacaattttaacttctagggttagcttttagcgtactcagaggaaaaaagaaaaaattccctggaaaaggggaatttatttcctttagtaaaacaaaaacccctctggagagaaacctagaaaatgaatccaagattcaaaagtagcatcaagggtgggcatgcaaagccagaaaaggagacccagtgacaacaagcagcccagcccttgactagcaaaaatactccctacaaagaaggaagtgggaggaatcactctgcccaattttaaggctcatcatttaaccatagtaatcaagactgtggtactggcaaagggaaagagacctagatcaagggaagaagaatgtagaacccagaaatgtagacctaaagtatgcctgattcttgataaaagttcaaaaagcattcagcaaagtaaggatataatctttaaacaaatggagctacagcaagtggccattcacaggccaagaaaggagcattgacctgcctctcacactttacactaagtcagttgtgacctttatctcttacaccaaatttacttggcatggctcatgcacctaaatgtaaaatgtaaaactatacaacttttaagaagaaacttaagaaaaaaatctttaggatatagggccagagaaaaagttactaggcatgacaccaaaagcttgatccactcaaggaaaattgaatctaatcaaaatttaaaactttcactctgtgaaagcccatgtgaagagaatgaaaaagaacagtaacaggcagaacacagaggattttcagggcagtgaaaatactgtgtatgacagcggtccccaaactttttggcaccagggaccggtttcatggaagataatttttccaacggatggggacggggaaggggatggtttcgggatgaaactgttccacctcagatcattaggcattagattctcataaagagtgcacatcctagatcccccacatgcacagttcacaataaggttcacacttttatgagaatctaatgccaatgctgatctgacagaaggcagagctcagggagtaatgcttgcttgctgctgctcacctccagctgtgcagcccagttcctaacaggccacagaccagtaccactgtgtggcctgggggatggggacccctggtatacaatggtggatacatgtcattataaatttatctaaacccatagagctatgtcgtttatgtcatcaagaggtaaccctaatgtacccaatggattttgggtgataatgatgtgtcagtgtatgttctccaactgtaatgaaagcatcaccctcatgggggatgttgataatgtgggaggctgtgcacgtacaggggtagggagtatatgggatacctccagacatgtctctgaattttgctgtgaacttaaaactgctctaaaaaaataaagccttattaaaaaaaagaaaagaaaaaaaagacaagctataggctgagagaaaatacatgcaaatcacacaggtgacaaagaacaagtatctagaacatataaagaattctccaaagtcaatattgaaaacacagataatccaattagaaaatgggcaaaagacctgaaaagacatctgactgaataggatatatatatatatatatatgtatggcaagcacatgaaaagatgctcaacatcattcggcattaggaaagtgcaaatttaaaccacaatgagagcacttcacacctatcagaatggatgaaatgaaaatattgacgccaccaaatgctggcaaggatgtgaaaaatctggattacactcatactgctggtgagatgtaaaatagtatagccactctggcaagtacttttataagaaaactcacactcatgtaactgcagcactttgggaggccaagaaaggtggatcacttgagcccaggagtttgataccagcctgggcaacctagagagagcccatgtctacaaaaaaaaaaaaaaaaaatttaattatccaggatggatggcatacagctatagtcccagctacctgggaggctggggcaggaggattgcttgagcccagaaatctgaggctacagtgagctatgatcatgccgctggattccagcctgagcaacagagactgtctcaaaaaaaaaaaaaaaaaaagaaaagaaaagaaaaactaaatattcaacctgcaactgtactcttggacatttatcccagaaaaaggaaaatttaaattaaaaaaaacaactgcaacaaccaccagtatgccagcattcataacagctttatgtgtaatagctaaaaactagaatcagccaagatgccaagatgtccttcaacaggtaagtggttaaactgtggtatacacatatcatgaaatactactcagcaataaaaattatatattccattaatataaaatttctgatatgaccaactttcagaaattgaagacggattagtggttgtcaggaatttgaagggagccaggggagagatgggtgtggctatagaagggattttggtggtattagcactgttcaatatcttgactgtggttgtagatacatgaacctacatgggtgaaaaaattgtgtataaatctaaatacacacatacgcacaaaaaagtataagtaaaactggggaaatctgactacacttggtaggatttttttggttttgttttttgagacagagtcctcctctgtcaccctggcaagagtgcagtgccatgatctcagctcactgtagcctcaacctcccaggctcaagcaatccactaacctcagcttctcaagcatttgagaccacaggtgcaagccaccacacctggctaatttttttttttttttttttttttttttttggtagagatgagattttgctatgttgctcaggctggtctcgaactcctgggctcaagtgatccaccagcctcagccttccaaactgctaggattacaggcatgagccatcatgtttggcctggtagactgtattaatgtcaatatcctgattgcaatattatactatagttttcggaaattataccactggaggaaaccaaactaagtgtagaagggctctcactgtattattttgtaaaactgcctatgaatccacaattatctcaaaattttccattaataaaaaagtgctgaaaattagtatcattaagatgcatactgcataacagaagtgaaaataccagcatacaaaagtagtgaaactattctaattttgttaaaatgtaagcacatgcttgtatatttcttcatttaaaaaaaaaaaaaagattaggagaaaattccagttaatacttgtcatttctgggtggtagaattacacatacctttatttgcattttaactttttcctcaaattttaaacttagttttcaaacagtctctaatgaatatatcgttttcatattccagtgttataaaaactgcttgatatcaaaagcagaaaaatccatctcatatatattttgtattacacacaatgtcaaagaacgtagcttgtctggggactaaaatattttcagttaagaaactatctgaggtggtcatgttaatttagaagtagcaaataaatacatcttttgattcaatcaataaaactcaccctacatattgctattttcatttgatcatttccatcagtttctattttagtaaaaataaggctttcaggaaaactgaacttcagaggagtatgttgctctgaataactgctctcttgcctttccagtcctggaagaatgccagtggtctctgacactcaaggactactgagagagacagaaattaagctggaaaaacacaattcagtctgtggttactaggaagttagacacgttttcttcccctgaaaattatctccatttgcttcagattcttcacaggcctccacttaacaccctctcgcagcacggtgcaaaacaaatctgtcagctgcaaatatggccatagaaactttttccccaattgctagggaaacaaagtgaacagcagagaaaacacctccggcaagactgtacggctctgctgtcatgttctgtgcaataactgtgactctctacttgattttctttggcccctggctctggggacaatttgcttcaacaaactagaagcagtcatatcacacctatgagtcatcttatggcctgttcccattcattggcctttggatttgggggttctccatagatggtatctctcctctgggcattttggaaatctgtaggggtgtttttttgtttgtttgtttgtttttttggcagagactcggtgtcaccaggctggagtgcagtggcacgatctcggctcactgcaacttccgcctcctggattcaagcgattctcctgcctcagcctcctgagtagctgagactgcaggcgcacaccaccaagcccagctaattttttttatttttagtagagacaggttttcaccgtgttagccaggatggtctcgatctcctgacctcatgatactcccgccttggcctcccaaagtgctgggattacaggcatgagccatcgcacccagccctgtagggttgttttctaaatgcagagaggaaggggattgttgcagcaactggacaccaaaactgggatttaacaggcagaatctcttaatgaattatgctatggcatgcatgacttaggactgtctcagtggacaggaagtgaaacgccaagcatctgaaccaagaatcttccttcatttcacataaaaacaaatgcacagtatgttttttatagttttaatacacatcacacactaaaccatgtaaatttagaggaaactgctactttttctttgtaactttactaagagttatcattttggaatattgaatctccaacagcaaggtctttctggtttacggtagcccattcgatgaatctgtagcaggtgcttttatagctgaaacattcacagtgattctatgtataggtgcaagcatctcactacttcattaagtcctaaaaagtcttgctactcaaaacgtggtcacggaagagcagtactgacatcacttgggagttaattagaaatgaagaatctccaggcctggtggcatgcacctgaaatccaagctatcttgagaggctgaggcaggaggatcgcatgagcccaggagtttaagaccagcctgaataacacagcaagatcctgtctcaagattttaaaagagaggggggcaggggaggaaggggtgattgatgcggcttccatttggaatttaaggcaccacgaagagtgacaaaggtcatggttgtggtggacacttgggctccaaaagaggctcaggaggagagttcaggccctttgtaccacatatcccgtttgatttctatttgtgtgaaatggccctcccctgggtcaagccaacacctgatgcaacttccttcagtgaggccttcctgaagagcaatcaggacccagctcctgattctgctgagcaggcctcttacttttccctggtgacaaaaataaacaatgtgattgacaatctgtggctccagggacatctgaagtgcaaattgaagaagttggataggtgggatcctataaaaagagaatggtcactacaggccacagtgcagctgccccgctggtaatacacaagattctgccaaggctggaagctgttgctgccctgggaaacaaagtcgggggaagcctgagagcacaggatccttctgaagttttgaccatgcctaccatgctgacgaaactggcttggaaatcagttcttctgatgctacagtgaagactgtcattacaacagtgccacccagtcttccaaaactggacccagaactccgtttggatatcaaggtattgcagggtgccttagcagccattcggcatgcccgctggttcaaggaaaatggctctcagttcacagttaaagttatcatcagactactgaaggacttgagggtttcgttttcctggctttgagcccctcacaccctggatcctaggcctactaagtcattatgctgtgataaccccaacagacagcctttggccctgaacactgcacataggtgttgcttgcagattctaggtgcaggactgttcctgccagggtccatgggtatcactgacccccgtgagagcggcaacttcagagtacacacagtcatgaccctagaacagcaggacatagtctgctacacagcccagactctggtctgaatcctctcacatggtggctttaggaagatccttggccaggagggtgatgccagacatcttacttctgaaatatctacctgggatggagtgatagtaacaccttcagaaaaggcttacagtagtcattagagaaaaaggaaagggaggaagaagagaagacagaagaaccacctcaaggagaggaagaagaaagcatggaaactcaaaagtgaccttcccttcactccctttcctacccaagggggaagactgaggcttaaggtaggtgctactggtaggtgctactgtgctttatatggtgacagacatttccgtggggtagggaagatagcaggaagggaaataaactctacagaagtgtcattccactgggttttgacattggcttagcagccaatatcaaatgttggtatccttcttcattatagatgaatggcattatgacctatgacattcatctacaatgaaggaggataccaacatattttcctaatattctagaatccccacctcctgaaaacccctctcttaactaatacttagcaggatgaattatctattcatcttatattaggataataaagggaacacattgaaaatatttattccaaatcagagaggcactgacttgagaactactgagtaagaaactattgacgctggcagctctgtttgtacctttatttttctacactatccctactctggaaaaacagactgcaagagaagcaaatgtaaattttcctcgactatgatttttgtgccccaaattgtcctcactgaggcaatgagatgttaagtcactaaaatgtggcatctaatgcaacttgacactcacaaatggaaacatctggaaacacatagtccctctgaaacccagacatcagtctcttcaagggaaaacaaaagctctaggagcacttcccttgaacaatctttttacttgataaagcattccaccttactgcttctcacaaggaaatatgccttagcttttatcaaagtaagttctgttttgaaccaaaataaagacaagattggattttcccaggatacaataaaacagacctgagttccatgttcctaactgctcaattctaccaaagtgtcccaccagcagctcaaatacacttcaccttcaaatttgcactcagtatcttctttcctaaacctacattttgtcctttgctccctatttcagttaatgacccaaagtaaataaaaataaaaaaccactccaatctcctagttctacaataataaaatatccttcggaattaactacgtgccaggtcacagtgacaccaaggcaaaagacacatcatccccctagtggagaagcccacagacaaggaaaactcctgggctggttacagttacatcgtctggaatattcaaagtcatcttggaatcctccctctcaactgcttcccacagtgaaatgtcaggacctgttaactttatttttgtgccaagtgctcattgatttactccatcagcaactagtaatctaactaacctaattagctgcaacttaactaactagaaggtcaattaactgaaatctttttaattcaattcacaggaaaaaaggtttttcacaagccagcaagctaagggcaagtatacgggatacctgtcatttttaccctccaggcatacgtgtctgctgcttctggccgcaccacctctattttcttctggggatctgtatcccgtgccccttccccggctcagcacatgttgtttcaatgaggttgaccctactccttggcacaagagctgcacacaatccagctctgcctaccacagcaataggagtggctgcaaggaaaggactcactgggcccaaatcagccaatgagatttaaatcagggactttgttggaaggataggaaataaaggtttaatttccactgcaaatagagtagactacatggagtctatttgattacacaggcaaatatattccttgagaatcaaatgaatacagaggaagagaaaaaccaagggacagagaagggttgagtcctggtgacacactcttttagcttaaaaaccccactcctgatacactgtcacactgttattgctgtagacagttggagttggctttctgacacttttaaagaaagtcttagcagaaatgttttaaaatgcttttttaaaaactgctgaatttttttagtcaaaaacagcactaaatatacaactcttttttctttctttttttctttgagacacagtcttgctatgtcactcaggctggagtgcagtgtcacaatctcgattcactacaacctccacctcctgggttgaagtgattctcgtacctcagcctctcaaatagctgccaccatgcccggctcatttgtatttttaattttttttttttttttttaagtagagacagggtttcaccatgttgcccaggctggttatgaactcctgacctcaagtgatccacctcccaatgtgctgggattacagcctcccaatgtgctgggattacaggcatgagccaccacatccagcctagatctacattttaaccactattatagtctatgttaaaaattgatattttgaatgatgcctatgaaataccatgatataatactatgatattctgagcaaaagaaattctgaccaatatgccccacttaccaaactagcaaaatgtgcacctaattttagactgtccagagtgaccatcctgagagtatttcttaggacactggtgccttaagaaaaaagaggttcagcctgggtgtggtggctcaggcctgtaatccaacattttgggaggccggggcaggcggatcacaaggtcaggagattgagaccatcttggctaacacggggaaaccccgtctctactaaaaatacaaaaaaattagccgggcgtggtggcgggcgcctgtagtcccagctacatgggaggctgaggcaggagaatggtgtgaacccgggaggaggaggttgcagtgagccgagatcgcgtcactgcactccagcctgggcgacagagcaagactccgtctcaaaaaaaaaaaaagaaaagaaaaagaaaaaaggggtttcagagcaaatgtatgtggcaaagtctgcataccacagccccctcttgggaagtcaaaatgtatgaaatagcaaaaaccacaattacttttgcaccaacctaaatacattgacacattatgggctctgtaatattctacactgagaaatctgttttccttctttgaccacataacttccttttataattattatttttatttatttttagcaagtgtaaacttttagcagaacattatgttcaggaaaacactgaactcaaaggcccaccagctccaccttaaacaaattcctattctagtctactgctgtattgagaaaaatgaaaaaaccttgaatttccaaatctaacagaatttaaatctcactacctcagcgtgaatcaaaataatatagttccagaagttatactgtcagcattatagtacatttatcaattctgtatttgagactgctgtggtgtgtttacatctgagcaagaagaaaaaggcatggctaactggactgaaatcgttccaggaaaataagtgcttaaaccagttccaacctaattagcttctcacaaaacctaaaatcctgcttgatgcaaccaaatagccattattaaatcaaaatccaaagtgctacatttcagaacagaataaaattcaagttgtagctaattactccaaagtcaaaatttaaatattctgtatttgtgattgaattacatgactctaacactacttgagctaaatcaagtagacaagtataggtatataagacctttttttaaaaaaaaaatgtgatctggacattcctagatcagatgttctaacttagcacagtgagacacagaactcaaggaataagcatcattgagaactctcaatgttagaacatgcgatacaaaatccatgttttaaatgtttcaatggtcaacaaagacagatatcgtttattcattgattcattcttgcttgtcagcacacatgaattcatttagcagatatttgctgatggcatactctgggttaagaactatactaggtgatggggacagagcctcccctcatgttatgggtgaaactgtgcctccctgccaaccaaactcatatgttgaagtcctagccctgagtccctcacaaaaagcctacagtggccttgacttaccctacatagacttacacaattcatatatccctgagagatagccagtgtcatcaccaacatcatcatcatcaccatccccattttgtagataaggaggctgctatggtttgaatgtatcccaaaaattcatgtactggaatcttgtcccacagtgcaactgtgttgaaaggtgggacctttggcaagtgattgggtcatgagggctctgtcctcatgaatgaatgaatgcatgggttatcgagggagtgggtgagttgtcatgagactgagtctgttacaaaaaccagtttggctgtctcttgtgagcccccttgccatgttatgtcccgagccaccttgggactgcagacagtcctcacaaacaagaaggtattcatcaaatggggtcctagaccttggccttcccaacttccacaattgtaagaaatattgcttttttgagacagggtctcaacagagcagacagggtcttgctctgttgcccagactggattacaatggcacaatcatggctcactgcagccttgacttcctgggctcaagtgatcctcccacctcagccacttgagtagctaggacctaccataggcatgagatactatgcctggctatttttattttttaaaaaaatttttatacagatggggtctccctgtgttgcccaggcttgtctggaactcccatgttcaaccaatcctcccgcctcagcctcccaaagtgctgggattatgggtgtgaatcactgcgcctggccacataataaatgtcttttctttataaattacccagtctcagggattcagttacagcaacagaaaacagactaagacagaggctaaaacttgaaaaggttgaaaactttcctaagatcatgtaacctttaaatgcagagcaaggacttggacccttgtccacagtgcccccatacaaccgggttccaaggcacctggaccataaaatatagcacaagaattgcccacgtttctaagaaggccaagtgagattctaaagacactggaaacttgaaaaagtgagggaaatgcccacaatcataatttcctggaggagctttaatgccttatttgaaatgtctactgtcctctcaccaaagaggaatccaggttagcctctttggagagaccaaaggcggcctgatccaagaagaccagcagatgttgaattctgacagggtatccatattcagaacagtttttttttgtttttgttttttgttgttgttgttttgttttggagatggagtcttgttctgtcacccaggctggagtgcagtggcacgatcttgactcactgcaacttctacatcccggattcaaacgactctcctgcctcagcccccgagcagctgggattacaggcgtggaccatcatgcctggctaatttttgattttagtagagagggggtttcaccatgtcggccaggctgatctcaaactcctgacctcaggtgatccacccacctcgacctcccgaagtgctgggattacaggcatgagccaccgtgcccagcccagaacactttcttaacggaggaccaaaaaaatgagtaaaatatacagacaggttattttttaatcagcagaaaatcaataaagatgaaaactggtgatgtaaaatagagccagataactaaccaaacaaacagaaaacaagaggcattgagaatcagacttcctacattctgtaatacactcaaactcctttaaaaaaggttatatctaagccatagcagctgtggttattattttcatataaatacttaagaagtgtcatacactgcactaagcagtgtgccttgagcaaatcacttaatgtttccatgccatggtttaatctatagggccagcatctaccccacctgtctgttgtggggattaattgaaatggtatacataatgtgctttggaatatgcctggcgggtagtaagtgctaaaaaaaatatgaagtgttctcatcaccaccacccggggttcaaccttctaaggaggatttcttcaactccatttttcagatgagtaaactgaaccttgataagccatcctcaggggtcagagaacaaaagggacttaatcaggacagtttcggcaacaccaaaagttgattctggctaagccttcggctcattcccagcaatacctggaaacagctacaatgtgctgcaaatagtagtgcccaggtatttccacctaacttgtactcctgtgactaacccctgagctgcactactcaaagcaaggtcctctaatgcataataaaacaaatttactaaaaggcagaaatctattaattacaaccaaagacttccataacaaaatactgcaatcactactcactacctggctggctgtctctttgaacaggctgagataattggttttctttacattttatttttcctactgaattactttttttgtgtgtatgtattagccactaccacattcaggtacaaagtgtgaaatttcttttgcatataaggctgctcgtgctcaagggaatatttagtaaattagatgggcatttattaccaaaaattacgcaggaaggaaagggaagaaggtccccaaattaataatcttattaatacacaaatgccatgtgaaatccattctcttctactcccctgaacaattctcttcaacagagataaccgataaggtagaaaaaagagggtcagagagaactgaattcaaggaagaaagacaaaaatgggaaaatgaatacaggataaaagatgtattttaggtgggagactgttgggacaaagttcggcctgattcaggcatcacccccattaaataatagatgtggccaatcttgtcccagggaggtaagacttgcagagttcaccttatggaagcagatcataaggatacatgtgaaccaaaggaaaacagaaggaggtcctggatatcctccgcttcagtcctcctagctccagggaccttggaacttgtacttgctccctctgcttagactgcccattccctgttcttgaaagggccaactccttatgttccaggtctcagtcacatcctttttcttcccaggacatatgatctgaaattatgaagttcatccatttatagacttgctttttttatgctcagtaggtattgctgggggatgaatgaatctacagtagacgcctagacctcttttaaggagagataaggcactggaaagccatttgatatttgaattgttggaaaagaaataaaaagacttcatttgctgtgcagattccaagggctctcagttccagctgcaggccatgtcgggaagttgtcccagtcaacatccaggacactgggaaaggcctctgtggttgatttgtgatgtctgccatgagtgtagccaccaatatttgtgctttactcactctttactcatcctacatcacctaagatactttccttgttgctaccctccacaagcagccagaatgaccctcccaaaggtaaggcagatgctatcacaacacttctcaaaccctccaacagctcctcttctcactcaagataaaatccaatggccagtcaccgtccatctcccttcccaccaaatgggttccagcttcactggcgtctttactattctacaaatacagtgagctcactcctgcctccctatcttagaagcattttcctccatcagaaacatcccccttccctaactttctgcaggtacctattcaactcaccttatcaaggaggccttccctgctcaccctatgtaaagaaaccctctgtctccatcactttctgccatttcattcagctttagtcttctttataacacctaccacttgagatacatttttttaattatctgttttcttcattcaccctttgtagcctccccatccaatacctttatattggattttatccaatataaatataaaggaattttatcctttacattcatggggcatctctaacacttagaacagtagttgatacataaggagtccccattaaatatttgttgaatgaataaataaatgtattccccacttataattaaaataattaaaatgattaaggccattttcatctaaagaatagcttaactgcccatgaaaatacatgtccatgagcttcatgttttttttccctcctgctagataccaaaaacagaatttcctaacatttgtggcaatacaataaaataaaataaaatatacatttggattctcaacaaaaattaatgtatcacaccacagcatacatataataaagaaacaagaataggggaaaagccaaacccttacaaattttccctaaaggagtggttctcataatgtgatccctggactcagcatcagaagcccagaacacttgctagaaatgcaaattagagaagaactgaaggaaatagagacacaaaaaacccttcaaaaaaaggtaatgaatcgaggagctggttttttgaaaggatcaacaaaattgatagaccgctagcaagactaataaagaagaaaagagagaagaatcaaatagacacaatgaaaaatgataaaggggatatcaccaccaatcccacagaaatacaaactaccatcagagaatactacaaacacctctacacaaataaactagaaaatctagaagaaatggataaattcctcaacacatacactctcccaagactaaaccaggaagaagttgaatctctgaatagaccaataacaggagctgaaattgtggcaataatcaatagtttatcaaccaaaaagagtccaggaccagatggattcacagctgaattctatcagaggtacaaggaggaactggtaccatttcttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaatgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaataacccttcatgctaaaaactctcaataaattaggtattgatgggacatatctcaaaataataagagctatctatgacaaacccacagccaatatcatactgaatgggcaaaaactggaagcattccctttgaaaacgggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaactgctgctcaaggaaataaaagaggatacaaacaaatggaagaacattccatgctcatgggtaggaagaatcaatatcgtgaaaatggccatactgcccaaggtaacttacagattcaatgccatccccatcaagctaccaatgactttcttcacagaattggaaaaaaccactttaaagttcatatggaaccaaaaaagagcccgcatcaccaaggcaatcctaagccaaaagaacaaagctggaggcatcacactacctgacttcaaactatactacaaggctacagtaaccaaaacagcatggtactggtaccaaaacagagatgtagatcaatggaacagaacagagccctcagaaataacgctgcatatctacaactatctgatctttgacaaacctgagaaaaacaagcaattgggaaaggattccctatttaataaatggcgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcgtgggcaaggacttcatgtccaaaacaccaaaagcaatggcaacaaaagacaaaactgacaaatgggatctaattaaactaaagagcttctgcacagcaaaagaaactaccatcagagtgaacaggcaacctacaaaatgggagaaaattttcgcaacctactcatctgacaaaaggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgaccctgccatcccattgctggttatatacccaaaggactataaatcatgctgctgtaaagacacacgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaacaacaaaaaaccaaacacctcatatgctcactcataggtgggaattgaacaatgagatcacatggacacaggaaggggaatatcacactctggggactgtggtggggtggggggaggggggagggatagcattgggagatatacctaatgctagatgacgagttagtgggtgcaacacaccagcatggcacatgtatacatatgtaactaacctgcacaatgtgcacatgtaccctaaaacttaaagtataataaaaaaataaaaattaaaaaaataaaaaaaaaaagaaatgcaaattcttaggccttgccccagacctactgaatcaaaaactctgaaggtagggccccagaaatctgtactttcacaaaccctccaaagcacactcaagtttgaaaactactcccctaaagaaaaatgtgagattttagaaactgatttttaactacatacaattttgacatttttggtttgtacattaaaaatatgacattccttataagatggttgagatagcctctaaagaatcaatagcaggctgggcgcggtgactcacgtctgtaattccagcattttgggaggccgaggcgggcagatcacgaggtcaggagttcaagaccagcctggccaacatagtgaaatccggcctctactaaaaacacaaaaattagttgggcatggtggtgcattcctgtaatcccagctactcaggaggctgaggcaggagaactgcttgaaccgggacccaggaggcggaggtcacaatgagtggagatcacaccactgggcactccagcctgggctacagagcgagactccatctcaaaataaataaataaataaataataataataacaatagcaaatttcattctaccatttgaccaaattataattttgaatagtaatcatacatgaattgatctaatgttttaaatattttcctaaaatcaagctttgtattccatggctgccctggatctacttataaataaaactgaacaaccacatctgatttcatcctaatgttgtgatttttttgggtagcagttctgataattagtagggatcaaccaattaaaaaatgactgtaacacgtcgtataagaaaccctcaaaggatagaaaatgtgaatctctaacagcctcacatccaaaaatttcaccaaacatctttacctgaagctgtttctttaattgcttctaatgaagttgatgcatgtgttaattaaatattaagtgcaaatgtgagtacttctaagaggaagtacagctcttcaggtcaccaacatactccttacacccaccaatcctttagaacatgaaggctgggacccccaaatcacttattcaaccgcccctttttaacacaatgcggccaccatcagggggctcattaccaacttggaaacacaaaaattatgtccacaatatagcttaagggcagtttctaaaaacaggtttaccaatattaattgctggccttgcactaagtgttattcacatattatttaattttcacaatagctctgtaaggttttcatgtatccccagtttactaatgaaaaaaactgatgtaccaatagattatctaaaattctcataaaagaaaagctctaacttgattccaagtagcttttttcttgagacagagtcttgctcttgtcgcccaggctggagtgcaatggcgtgatcttgccttactgcaacctccacctcccggggtcaagcgattctcctgtttcagcctcccaagtagctaggattacaagcatgcaccaccacacccagctaatttttgtatttttagtagagacggggtttcgccatgttggccaggctggtctcgaactcctgacctcaagtgatccgcctgcctcgacctcccaaaatgctaggattacagccgtgagtcaccgcgcccagtcccaagtagcttttaatgcaaggttcacttttcttttttttttcctgtcacacacatggctcccttgagcttccaagacagaccccaaataaaggcacttttattataggactgaaaaagatgtgactaggaagagcttgaataagaacttcatttgccaagaaatggtctctggtggactcagatttttcccttttttcttccttgatgctcagaatcacagctgtacatttctaacaaaaagatatatgaatcagagacagccaatatgagcaaaagaataaaatagaggagaaaatagtaagaaatggctgcactggtagccgtgataaaattttaatttgaacattttctgagaacagattttagcttatcaagcgctatgcaaattatatgcaaatcccacacaatgcctgcatatattccccgacgcttgttattttatttatttattttttttgctctccctaggatgtggcccttaggaaatctacccccttggctcagcactctagatggaacatttgctatactgaagatgacaaatctgaaggtttctgatcagtattcagtacctgtgtttacgagcgagcccactggtcccccataatagcagcattaaatccaaatatcaagtggaatttatatacatatattttttaagtgtcagcttataaggcctcaccctagttacaggcaatctttagccaccctgcttctttaaaaatcaacgcacaaacacaacaaaccacctcttggatgtagtcattaggcagaaagagtttccacagtggaacccaatactgccataacctttaaggtcaatgttgtaatttatcatgggaccatgtgcaggctaccccaggagacatctctcacatggcagaggtgacacacacgacagtaaggtgtcaattttacaatatatatgcagaatccaggccagaagctattaactagtcttgctagcctcttctcactttctagaattaattaccaagccctctcctaccctggtctttttgcttgttctttaaatgctcttgactcttctacacgcctttgcatccttcagggcacagccttaaagctcccttctctgagaggccttccttagctaaagaagataacccaattattttctgttaggccacctgtatgtactacaaccactggtacttattttgtttgttttacttacttatctccttcaggatctgaactccttgaaagcagggaccctgtccatcttgacaaccaggatattcctaaagccttaatgcacacttatcacataaataaataaataagcagctcctcctttttatttccactcccaaaagcttgggctcagcatatggtggtgagaaaccgtcttccttagatctctgagatgcaggactaccccctgctgagaatgatggaaggtacccaccttcatagaatacttgcaagcagaatctggagcagagacactgagaggacgggcttggagaggcagcccaccctccacgttcaggagcaccatgctgcacctgacaatctgcctcatttggccttcaaggcatgatgcgcatctctctactgttttggcagggggtggctggctttcagtctttgctgctatacgtgcttcctgactactgaaccagaagatgagcaaatctgacaactgctccaatgcccagtgagtttaactagagtaatgaacaccacaagggcatctgctggacgcaggagtagggtgtaagtgaggacccatgactggccagtcaattgtctattcaaatgctagcaagattgccctggacaagttttctccctgattagaataaagacccaataaaaaaaaattgtctaagaatatttaaatatactccaggtgccctttctcatttcattagatgaactgcccttaggcaattctacccaagcccaaggcttcaattgctctttctctgctgatggatcttccagccaggacctttcttcctgagctcctcccagaaatccagctgcctcttggacactgctacttggatatcttgcagtcatctcagactcaaaatgtgcaaaactcacctaaggtcacactaatagaaagtggcaggctaatttatagtttagatgacaccaaagaatatacacaggcttcccagtgtgcccagatgcctccacctcattgacggggatgcctgcgggagagaaggagggagagtgccattgtaccaacttgcttgggtaaatgaacctcaggaaaatgagttctagattagtaatagcaatgaggatgtcaataaaattctacctgacctcccattaaccctgggaactgttaacttcagtgttagctagggatttcttagacatgcatgggcttaaagttgtttcaagaaattcacttgcttagaattcagtgagtttttttgggaagctggtacaatctgaacaaccctttttattgcttactttgcgttttaagggtctcagttaatgaagtatctcctagcacaggggatgagaagaggggaaagaaggcagggcatcaccaatccactattcccttttactaatcctcacaggaaaagaccatcctacaacatcctccaagtccagctggctatctgttctgcctcatttcttctatgttttattccaccaacacgaacaggcttagttttccccagccctgaacagagctctgtcctccttaggagacacctcatttgcagtttgtttccaagcttcaactcattccaatgttcttagacacagttgttaccaaatgagcaccagccccaagtgtcaactcaactgccatgtgaggagggagcatctaccctttccagtgggaagctcaaatcaggctggctgtcctagattgcctcctttccccaggcttcctacggggtttctagacattaccacttgccaggtttctcctgccctcgatcttctctgttccttattatctctgtccagagagattattttgaattgaaacttttcttcctcatctgacttggcaccaagaacttgcacatttgacaaaagagtcaatggggcttatgtggtttttaaaatttaggaatgctatggtagtcacttcaattttctttttcaacaatcattttaatcagtttctgaaaatttgtgtgcattcaagtgcatgacgacataaaaattcatttaaaaaaaaaaggcacaagtagctaacactttgtagaaatgcgcctctatggtgagctaaatctctctccttcttttcagttatcctctagaccccgtctcatcacagtctgcagtagatgtgcacttctcatatttacctacccttcccaataatccctattttccttctagacccaagacacggctttctactactgcacagactcctccgcggtttcctcaaatccccaaccaattaaaaatggctctgcctggctgaatttctagagacctttgctgaggttaaggatcagtcacaattcatcttatattactttcatacaaatactagataggacagaaatgcagagaatttcagaagattttgcaaaaactctcattgtcatggttttaagtcaaactaagttcttatcaaggcctatttgaagaaaaaaaaatttctaagcttacatttggataataaagtgctattttaagtactttaatgttttcagagtatgttagcttaactgagtattttctctgccctagaaaatttcacaaagtggttaacattcagtggcacaccaaggccagctatgatgtgctttttgaatttactgaaattctaattaaatacagagtatcttagtaagccctcaagaggagcaataccaacaatacattatcccttaaaaaagcaactgtgagcattcactgaattgtatactttaaaatggttaagtttgtgttatgtgaattttaccctgatttgtacaaaaagaaattgtacaaggtgcaagtcagtctaaacaacctctgatggtaatgcttctttattcacatggggagcagccatgagtatcacattcaattgcagaaaccctaatttatggctttgaataattctcaaaagctaagtcataacagatcttgaacattttcacatacccctagataattagacattaatgtgtcccattccaaagattacttgagtttggaaaaggaatttcaaaatcaaatggctacaaaagtttgagctcactaatatgaaacgaacttttaagtctcttgttcagacagggttaatgtataggtttggggctaatccttcctctcaacagagaatctaatggagtgttagcattaatgttcttattgattggcaaaataaattcttatggtgaagatatatttccttatctgcagtatatttctgtagatgaaatgtggtatcatacaaacccagctctgagtccatgagtaacaaatccttctgtaaagtacaaactgactgtatttgtgagaatatgcctttcagcattttctattcaacagctcagcaaactaagttctccaattaatttttttttctaatcaatgtaatgaaaacattagcacttttgctacattttgtcaggaaaaccactagtagatggtacacgggctagtttaaatttcattttgctttgcaaatgggatttaaaacaaaataatctttaccaaattgatgcttctgtctgaaaggaccaaaatttatgttttaaaaaatgctctgaaatagcaaaccatggcaactgttgacatgaatgagctaaatctgagcggaactcttaaaagcctcactgggatatttagcaactattccagaaagactaaggcgccataccatagcctctgccttccctgaaattacccagcctccattcactgacttaacaaatgtgcgcccagcacctcctgggtgccaagcacagtggtctgaatgggaaactgtcgaaaatgagccaaagtcctctctctcaatgagctggcaaacagcatcacaacagactgtgccaaataaggacagaagaaggcttgaggtggttaggagtccagaatatcctggagaggagtgaaagataaggaggatccagacaggggatgagaagggaaagagatgtggaggggaaatggaaatgcaaaggtccagagacaaagcaaatctgacagcattactgacttcatgttgactacagcgtaatggatgggtgggtggggggaacagtatgggatggaaatgaaaacgcaagcaggagccagagaccacaggactctctcagccatggtaataagttccagcatgttattttaattgcaacaggaagacactgaaagactttattcaggatgctcaatttgctttaaatcctagtcctataattccatctcacaagacataaacaaaaaatgtccataccaaaaccacctgtggatttcatttatcatttcaagtgaaccaccgtctcggcatggcagtcggataaactaaagacttggcaaaagatttcagggaatgacagctcattgatcaaacacgaatgtgtttgccgtagttactgtagatgttgtataaacttctattcccaaagtctgaccaaaccttagatgtaggcaactttccttcagtgctgattggcagggctctaatgtgtaatctaaaaagtgaacctgccatttcacacttccaaattaaatatttaatgactgatatgtttcagggttgatgctatgccacatagaagcactttgtcaagaatcaaaccatgcaattgagatggcaaaagagcacagtggctcacacctgtaatcccagcactttggacgtgcagcctcgcctccccgagtgccagggcaaccggcctgagccacagcggctccctatcccagcactttgggaggccgagccaggtgattgtttgagcccaggagtttgagaccatcctgggcaacacagtgagacactgtctctctaacaaaaaaaattttttaaatagtcaggcatggttgtgcgtgcctgtaggcccagctacttgggaggctgaggtgggaggactgcttaaacctgagaggttgaagctacagtgaaccatgatggggtcactgcacggcaaactgggtgacagagtgataccctatctcaaaaaaaaaaaaaaaaaaaaagttggcaaaagaatccctggagaaaagataattattaagccacaaagataaaaagatatttcaccaactatggattttacacaccctctcaagcttctttctcagtaaaacctttaaactatattgatagctgaaccagagaggaaagcaagccaataaaattaggaggtcgctaaaaatccaaagtcatggccatgccaatccaacctgcggctgtaactgtgtgaagaatataaaactggcacatagaaagaatgaggtaatattggataaggtatcaatgtctacacactttaaaagcatctcaccatcaaaaagtatggaattggacatagttctacatatgtcctatttaccaaaataatcacccctataaatgtaacccacttcctggagttgaaaaataatctttagaatcaacctgacaaagccaatgcctctcttacctgaggttcaagacaggacaatgatttacagataggacccaacctggcttttccccccttttaaagaaatcaatggcatttaaatatggaaatgaattgttaaaagaataaagagatggtagtaaacgccaaaagaagaggaaggttagctttcattgggataagtatcctctgtcctcttgtaattaccagtgagaagctcttctgtgcctgaggaagagagacagaacaggctcagaggagcagccaggtgcttgcttcactgatagaggtgacagacccctcagagacgaagaagcagagacggactgggagatgccactgcctcacttaactcagaacatctctttcttttgaaacttgaatttggggagaaagtgctcaattatttcttctagttaaggcttgggggcagtcaggtgggcaaatcggtcattggtggtggggaggaaagaaaaaaggaaggatgaaaaagtgagaaaaaaggaagggagggaagaagaggagaatgatggcaagagagtaaaaagcaaaagaagaaagaagagagaaagaaaacgggggaaggacagagaaagaacagacaagagctagcattatatctcttctggtggcttccagacagactgccattcttctcaatcaacccttcccttctttcttctttttcttcttcaccaaattccaggatacctgggtaggtgatgaacatgaggagaaaggagaaacggtaaatccacccaagcaggaaggagtaatttccaactctatcacccatctcccaatgcctcacaaattctgtggccttagaggggcaaactgaggttttataaaggttaacagaggttttataagggttctaatttacctggacctcagaagagggacaagcctgcacatctgggctttggcataacagaaattatgcttaaagttagccagtgattttcaagtaaacatgaatatgtatatacactacatggccgttctcttttggtgacagaaatgtgctcagcattcacatcattctcgcttggttttttccaagtaatgaaaaggggcaacgagaaaatatgcagctcaacacatttcttataccaatctccaaagcaagggcagtcagtggcatgccagaaatgaaaacctgctatctcttttttttccagtccaatgcttagcacactggattacagagccttcaaaagttttaagaacaggtatctttgaagctgtcttttgtcaagtctctgtcattaaaagtgagttgactcacctacctctattaatacatctgaggtctctcttcatctttaagagccactgaatagagcaagattggaggataaaatatttaaacctcttttaggaacatcatgggtgagttttgggaaagcaaagataccaaattagagacaacaggaaacgtcagtagtcttacggcttttctttgccaacatgagcttctagcaagaccagatgcacttcggatcagcctttccataacttatccattagagatgtctttaagcacattgacacccaattttgccaccttcatctgaatatgagaagagtgctcatttcacgttttcacgttgcatttgacagattaaaacttgaagatatgtttttgtcaagcaatttgaaaagaattttagtagctctaattgacgtacagaactagcctctacattaattgaaacataaaccataactggtgtaaatcaaatcatgattgatactctcttgcctagaagtatctggtgtgaattaagttatgagaaacactgcatcccaaaccagtgaccttacaatcaaagcttctccaaaaagctgacttggtgagcaaatagtgaaatgtgccacataaagcccaagcttttgacttctgaaagttgtcttttgtagactaccttgttgttagagaaagtatgttaagaggttactccccaagatttcacaagcctttttttaaaggaatggttttaaaaagcaaaatactataataaggcaaaatagaaggcagacaagcgatcagtgaaaaggcaagcttaaactaggtaagtttagaagatgtctttacttggtgaatcacttattaaccttacatttcttttttttttttttttttttttttttttgagacagagttttgcccttgttgcccaggctggagtgcaatggcgcgaccttggctcaccacaacctccgcctcccaggttcaagcaattctcctgcctcagcctcctgagtagctgggattacaggcatgcaccaccatgcccggctaattttgtatttttagtagagatggggtttctccatattgaggctggtctcgaactcctgacctcaggtgatccacccacctcggcctcccaaagtgctgggattacaggcgtgagccaccgtgcccagccttaaccttacatttctaaagcactaagaagtttctagatttgagttaacactattatctcttgaagctcatataccctacgaggtagacaatgcagatagatacagtgattctcattccacacgtgaagaaactgattttcagagactaatttgcccaaggtcacacaacaaatcaaggtagaagcaaaacttgaaccaatgtcttccagtgtccagttcagcacttttcaaccatgcccttcttgactaaggagtccgttttaaatatatgctttcccaatgcccattgatacagactttctcccactttcctaccatttctccaactgttccttttttctctctgcttaccgtccttgttctgtcccctaaatatagaccttcaactgtttgccttttctttttgtaactcatcccactagatgggtctcatccattttcatagcctctatgaagacaatgaagacaattcccaaacctactggttccagtctacaccttaaactccaatgccacatgtccattcaacaactagtcaccaaacaccaagtgtgttctaggtacagtgttagattttttgtggatgatgctatgaacaagagaataaaagtttctgccttcatgaagcttgcagtctagaagggttgaaataattactagtaagaaacaattactatgaactgtattataccaaggtcaaatagagaaggacattcagaggaaatgaggttgaagtttggaagccagatttctttgaacaggcttcagattttactttggaaccacataaacgttttattcaaatgtaaaaaggttttagataaacaatctctaaaaacagataattcaaaactccaaaatttgagtttatatccataacaagaaatacctacagacaaaaaaaacacaaaaaaatctttaggcaattccctgctatgagcttagttttgtccccccaaaattcatctgctaaaatcctaatcctcagtacctcagaatgtgaatgtatttacataggccctttaaagaggttattaaggcaaaatgaggtcatatgggtgcgcctaatccaatacaattggtgtcctgagaaaaagaggaggttaggacaagaatgagcatgtatccagcagaaagaccaggtgaggacacagagggataacagcaggagtctggcagccaaggagcaaggtctcagaagaaaccaaacctactaacaccttgatctgggacttctagcctccagaactgagagaaaacaaagtccatcgttcaagccacctggtctgtgataccttgttatggcagcctcggcaaattaatacaatccccatattgtagactctctgatcatatctccttcagaacccttaccatattgcaatttatcttttattcttgtgattttggattgatatctatctcccaggctataaacttcatgaggacagaaagagagggtgtttctccaaagtgcctagcaaatggttggctcttgtgatggtttaaaaacacaacctaaaaattctgttacactcctcccattgaaaggtagggtccatgtgcccttctctttaatttgggctcttagacttgacccacagaatatgacagaagtgatttttgacagtttccaggtcaaagggttaagagaattccagttcctctctcttagatactcagtcttggcgcccacccaccatgctctgaggaaactgagccgcacagggaggccatgtgtaggttctggctgatggtcctcactgtcagtcccaaacaatgccagcaacaactgccagacatgtgagtcaggaatccttccagatgaatccagctgcagctaccatctggctgcaaccacgagagaccccaagcaagaaaaaaaaaaaaaaaaagccatgcgcgataataaaattgtgttttgtttttgtttttgttgttgttgttgttgttgagacagagtttcactccgtcactcaggttggagtgcagcagcgtgatctcagctcactacaacctctgcccccaagttgaaacaagtctcatgcctcagtctcctgagtggccgggactacaggcacacaccaccacacctagctaatttttgtatttttagtagagacgaggtttcaccatgttggccaggctggtctcaaactcctggcctcaagtaatccacccacctcggtctcccaaagaaattgtttcaagtcactatgttttggggtgatttgctatgcagcaacaaatgacctaaatagcattctataaatagttgctcaataaaacactttctaggaattttctacaaatgctgcccctaaatgctttgggatgtctctgcaaatctcagcaagtgaccatcactctacctttattctctcactggtaggctctccaattaaatattcattcaggaagctcatagctaggaaaggaatcttactgttcagttttgaccctaaatacagcctaagctttcaaaatgcagtaaagacagaaagtcctagagagagaatagctttccaggccccattccttctactcctgagccagtttctgttcattggcatttgcagcaggccctgctgtttgtgggcataaaacattctggttgcttgagtgatgcaacatcaccctgtcttctgcttcctctccctgccataccagccttagcaaagctgcagccatcaccatggaaactagcccgggaagaaactcaacattcttggtcaaaccctccatgctgtcacccacagggagctctggaaagagagccttgtatttgagtaaaaatggttctttcagattctgggaggtaaccattgttttccccctatcaagctgcaagagagattttttaaaaaaagaaaaaaaagaaagaaactcttttattacaaagtcccttccaatataatactggctgtctaccctgtgggaactactaaaacaagtcagacagaagcctaagccccaacaatttttgagaactgagctgattctaccactaaccgagaagggcagagatacataatagttaagcacaaggcttaagagccaaagagacctcagttcaagtcctggctccattactcaggacctggtaagttcattcattcatttatgtattcattcagtaagtattttgtgtgtgcctactacgtcacaggtagttttgtcaaacactgagaaaaccctggggtacaaaacagacatggttcctaaacatttactgcatgcctgcttcctaccaccaggcactaatttagctgctgggaaaacaaaggtgaacaaaataaagtccttgaatttaaagagctttcactccaatgctggaaaaagaggaaaaaaagttaaaataaaataacattattataagaaccacgaaggggacatacgaaaagctcaaacaaaaaaatcataaaaagcacctgactttggaactgcggtcagagcaggcaatgttgcttgaactctttaagtcttggctgctctatctgtaaaacaggcatgccaccgcactgggttgacgtaagggttaaaattaacccatgtaaagcgtgttcacagtgcttgcatacacagacgttccgtaactggcagttattatcaatatgacacatgaaagtgccttgagtgactcttgtagggagaggcattcctccaatggccctgacccctgaatgttcctgcaaagaacactaaggcctgaacaccctctgcctggaccactgcttggggttatgttcgcagtgaacaatcttgagagatgaggtaatgtctccatccaggaaagagcaggcttgcagtacaagaggcagattcccccagctcagggtttctcagtggcaaagcaaactcagtgtgtacaatctccacctgggccccttcgaatcaccctcctcaggacttggggagcatgggagcctacgtaaacatgatgctcatgccacttgttgtgctgtgagcaataacagcctttatctctgacccaagagtctcatgttggttgccagcatgcatgaaactgtataataggctaaattattagcttgtaagtagggttaaaaaaaaccgaagcctgatactgtctcttaagaatcatcagtgagcctcaatttagctttctacaggtaaatcaagtcctcaatcatttcttctctgacatcacagtctcttttaaggacaactcttaagtgccattatcataaaatgaacacacacacaccccccacaacaccaatttaaatcatctgaaatttctgtttaccactgtgaccaagcctggcagtttcttctgttcctcactacaggaaaaatagtatagatattaatgatggtgtcttgctctccccgaaactcagaaggagcagggaccacagacacaggtttagaatctggacaaaggatggtgacaaagatataagatgggtgggatggggagaggggtagagatggtggggggtgggatggccaaagaatcatacaaaaaaagaaggtgggaaatctaaatgtggtgtagtatacagatttgctttcaaagtgaagacttacctaggaagaaaaacgacctcagacattttaatcagcaatgctttgcaaaaaggcattttctcaagggtatatcactctcatcagatgctaaattggtgtaacaattttctgcatcccaaattaaagtaaaaaatgcacaaacaacaattatagtttttgcaggtcataaacattttcttggtccccttatagcattttcatccttctctccaggtcaggattttgattttttgttttggttttagtaatacaggtgtaagttcaatttgctatttcttgctatatatgccaaaagctcagaatttgaaatgcatttttaattaagcatactgctgggagtttggaaattccagttggaccagcatttgtctatttcatcttgactgcagaaatcaacattgctttcctctctgattaccacttactcctaggggtcacgtgcacaatccagggaaggaaatggcaggtacaaaaagacacgtacacacaagcaccaccgtttcagacacacattttgtttgtttaaaaaagaaatcacttggggaaaggaagcagatttatcacttctctcaggcactcgccatgctgtggaattatttcatgtgaaagataattgcatcaatgaaatatttatgtgcactcattataggaaaacacttcattttataaccaaaaatttgtgctgcttaagtaaaaaagcaggaagagtttaggttgtagaattccttccgttttggatttgtaaatttgtaaatttagtaaaccaaagccaagacagctgcacatctcagttgagatgttccttggagcaacagaggtgttggaagtggtttgttgaagtagagctttcaaaaagtttgtgttacaatcaaaggtatccgagactcagttctgtattctaaggcctgtgaaaacaaacaattatattccaaaaaaatcgtttacaaaattaaaccattcgagccccctcaaattgttttaaaggcatcctcttgtcctcaacttaggaactgatgtattagacaccatcttcttaggactgagacactgtatcagattcaggactagcctaaggatctgggatagtttcacacagagaatgatacagggactgttgtgtatgctacaggccagctgattgtaatcccaaagggatttgtgtaatctgttagaaaacacacagacctcagaatacatgaggctgtgaacataaatatatttcatcctgagaaactgctctgagaaggaaaataaaaataataaattcttctccatctaggatagatttatcagtcacttacctcgatgtgcagtgcacaaaaatgaggggaagggaagagcagcaattaggccgacacaaaggcagactatcttatttcacagagtggtaggaacagtggggaacagcaattcctttcttgctacctgactctgaaattcccagctctttaaaatcacttaattgcttatctttgcagggaatgtttacttcctttctcagtattctctctcccaaagctctgcctaacaattcttgtggtagtttctaataactcttcttcatgggacccaagataaaacgaaagaataaactctgcattcaatgagtacacatggaggacccatcactgaccaggctttgtgttaggtgctaggggttttaaaaaatcagcctatgaactgcagcatgatttaaaaagtggttttccaaactatgtcacagtttatcacaaaatcttagttgcagcaactggaagtcaaatcaacttgctaaagccaaaaagaaaaatattggtgaatgttgtaggcagaataatggctccccaaatacgtcctcatcctgctctgcaggatctgtgaatatgttcccttacatggcaaaagtgactttgccgatatgattaagtaaaggaccttgagatggagagacaatcctggattatctggatgggcaaatcacatgaatcttttaaaagaggaggccttttcctggctttagtcagagaaatatatatgataacagaagcaggctcatctaaaagacagtgaaagaaagttaatataggacaaacaaccgaaaagtcaaagagttgtcttcaaacccagttagactcaaccagtggttctcaactgggaacagttttgtcccttaggaaacatgtggcaatacctgaaaacatgtctgatgatcacaactagggttgggggaatgtgttactggcacccagtaggtagaggcaattcctttcacagaacatgtttccagcacgagatggagatgaagcaatctttgaacaggcatatcaatatacactttagttacatactagtaatgcatcttgcctttaagttatttcacattttcatgactctggtataaacagtcgaagtagcctgtgatgaaagatgacaaagatttcagagcacgttctcagatcaaattattacaggattcacgtacaaatatatgtgcctagaaactgatataacactgaggacaacataaaaacggagatgaaaacatcttgcaatatctagacattcccctatagcttcaagctcaaaactttccattccaggaatcacttcttagataggtctggcaaaagcccttgagttgattctgattggtccagcttagaccaccctctgaatcctgaactaatcacagtggccatgaggatggagcactaccctaagtgcccaagcttggtcatctgccctcccctagggccaaaagtgctgaatcagctccagctccacataaacctactgtaatagcagagtgtggtcaccaagagcaaacaacataagaaagatttttttcccccaagcttctactaccatggtagattctgtctaaccaagtgggcagagttactgtggaaggtttttatgaacattctataacatcttccatgcagaaatccctgtacctacactcgggaccttgaattgattggtctgtgactctaactcctgataaggtgttctacaaggtcacagtgacatacaactgataggctatgtcgtctgtggttaatgtgacatcatactggtcaacacaaacttttttttttagagaaagccatgaccgggcattctaacagcagaagcaagttacccagtattgccagaaacattttggctggacctaagagatagcttcctaagatgatgaaaaaaaggataacggtgagaactttttgcaattcctttcacagaacgtgtttccagcacgagatggagatgaaccaatctttgaacagccatatcaatatacatttgagaacagaaatgacctcgtgccccagtgcaaatcctacaatgttgtacctttgctctatcttttccaatctacttctatcacacttctattctctgcaaatcacaggcggttcactttagttacatactagtaatgcatcttgcctttaagttatttcacattttcatgactctggtataaacagccgaagtagcctgtgatgaaagatgacaaagatttcagagcacgttctcagatcaaattattacaggattcacgtacaaatatgtgtgcctagaaactgatataacactgaggacaacataaaaacggagatgaaaaaaaatcctttttcatatgaatctcccagaaacaacatatttgtcacatttgtatttaaatttcccaaggcaggtatcatgaggcatcctttacagatttccatctggtctttccaattgggctgaggtatttttccttcttttgtttccttcctcccttcctttcaaaaagcactaaaagaaaaggtcaattcccttttcctgccctctctctgctcctcaccacagcctatatgttgtttttcagaacttctacccagtagcacataaccctaccaaaaaaaaaaaaaaaaaaagacacaaagcaaacgccctaaattgttgaatactaaaaacaataaaaaaacatttgaaaaataactttttaaaccaaaacattgtgtattaataacaaaagcatcagaagacagataaatacaaagagatccacaaacagcagtctaactacataaatgtaaccaagacactgctatagatttatttgaattgggcttatatggatatatattacatacaatacacacatacatatatatacacatatatgtgtgtgtgtgtgtgtgtatatacatatatatatatctgggcttaccatatatacatttttgtagaatgtggatattatacaatgtttaatgtatatatattttaaattaaaaatattatgtatgatttttttaacttgctttctacaatttacatcatacattgtgaacactgttatatataaataaatattcatctataacatcattgttaatgcatagtattttattagagaagtaccataacttatctactcaacctctttttttttttttttgaaacagggtctcactctgtagcccaggctggagtacagtggcataatcacagctcactgcagcctcaacctctcaggatcaagtgatcctcccacctcagcctcccaagtacctgggaccacaggcacacaccaccatgccaggctaatttttgtatttttttgtagagaaggagttttgccatgttggccaggctggtctcaaactcctgggctcaagagatccatctgccttgctctcccaaagtgctgggattacaggcatgagtcactgcacctggcccatctactcaacttcctatcttgcacagttatgacagcagtgtcaaacttaaaaatgttacaattcagatgcacaaaacaaatgcaacttcttaattgtctatagtttatttaaccttccttaagagctcttaccctgacaggtagcggagtagtgctaagttattgttgacagtatctcaatttcttgtgttttaaatggagtctttgggtgaagtcactggaatgtaagttccacgaaggcaaggatttttttcagtttcatttcctgctgtattcccagtatctacagtagtgccaggcatagggtaagtgttggattaatatattttaaatgaacaaatccatctcttttttttaatgttaatgcaaatcctccctacaatgacatccaggtatctgggaggctcacacaatcttgtggcagtaggaagaggggtcctgtgctggtcaccgagtcctctgctctctctgctgtgaagtaccttacctgccaggttacccagtgtatgccccatgggcatctgacactgaagcctaccctggaagacttggctctgttctccaggcttggactgagtgctacgttctctcttaccaattccatcctaatttaaccccctcaaattctgatgaacctctgggcctcagtcccatcccctaaccaatccttgacttagcccatcttagcctgtacttctagaatgttagctcaccatcactaaagcatcacccacggtaagctcacaggctctctcctcaggaccttatacatcccccaagaaacacgtaaagcttccctttcataccaagtgggagatgaggaagttcaggatagatagatctctcaggccttcgctctgcctgagcctgatatgctcttattctttttttgtttgttttatttttttgttttgttttagagaccgggtctccctctgttgcccaggctggagtgtagtggtacaatctcagctcactgcaacctccacctcccaggttcaagagaacctcccacctcagcctctccagtagctaggactacaggtgcacaacaccacgcctggctaattttttgtagagacggggtttcaccatgttgcccaggctagtctcaaactcctaggctcaagcaatctgcccacctcagtctcccaaagggttgggatttcaggtgtgaaatcccacctgaaatccctggccattctcctaaacttaccgagctgctgttaacctgtcttggtatgggatggccctgcagtgtagccttcctagagttccagaggtagtgagaccaacgccctattgcttttaactaatatgtttgccaccactcccagcatacactggaattctgactccagggtataacataacacacacacatacatattttgttacttccctccctttccatcttccttgatccccacactccactaggcccgaagggctgggctccatgtcactctacctcttctgaggcagggacttcccttacttataattcatcatccaaaccaggatgcatttgagagtaaaaggggtgctactgataattaggtcaggataaggtgcatgaattagagctgtcctaagcaagctagtaagtgtggtcaccctagttacattaaacttgacattcaagttcaccactgggccttgttcttgatatgctaatgtaggcttaagggatttagaaaatcttattttggtagacaaaacttaagcactgactccttcctgccttcctgctttaagaatcataatcccttgaggcaaatggatgcctctgggtgttgggaaagaaggtcatttacacagaaatgtaaaagagaaaaacatattaatgtactcgaaaatactactcctcttatttatgctactccaaagaatgtgacaatgaacacttatggaattaaatcattgcacactgcctcagttggtttccttaaaatggctgtttctgtttgtatgttttgttttgttttttgttttttttttcaagtaagcttacatagacttgatttctaattctggaggtcgactaaggaatctgtaattccctactttcccagtgtgtctcaactctgggctctcgactatccagtttcttcttcctggaatgtcctcccacattctcactctgcccttacaagtcttgctttccactatgagttccctgttgctgacctccttccctcctccaatcctactactcagggtcagttgctctttccacagtgctctcacagtagagcaagttccatggcttaagaactgagtcaaccaattcgtgcagcagtcttgagaggtaggtggaatatttctactttgaatatcaggaaactaaacttagtatgtcgtgatacaagtactcaccacagttgatttgtcactatccaccttacctagatttgtttaagaattaaatgacctagtgaatgggaaaactctgggaaacagatgagaagccggacaataaaaaaattactttggggaccaggcacagtggctcgcacctataatcccagtactctgagaggcggaagcagggatggacagatcacttaagcccaggagtccgagatcagccttggcaacatggcaaaaccttgtctctgccaaaaaaaaaaaattagctagacacagtggcatgtacctgtagtcccagctacttaggaggctgagatgggaggattgcttgagcccaagagctggaggctgcagcgagccatgatcacaccgctgcgctccagcctgggccatagagcgagaccctgtctcaaaaacaaaaaaattactttggactcatcttctttctacatggttgttaaactctgtgataacaaagactaaattttatctaaatcataaaatattagtgtgacatgaaagcctcaagaaattatgaacaacgttagcagaagtttcacatgagcaaatttagccctccataggcccacatttctgtaaaggaacaaaagaaacaccatgtgagtttccagccacttctgtttctaacggtgaatacttgtgggggtaggggaggggtggaggggctggagggaacttgaatactacctttgatttttatagatacaagatgtagatatctgttgtagtaaaaaaaaaaaaaagtcacaaatgagaatttggagctcaaagatcactgagaaggagcaatgatattaggacatccctcatggacttaggttgcccggactgtcatcatacaggtcagaaaaagatgtcaggaaggcgcaatggagaacctgccttagagtctgaactagtggccagtgctcaacaaaacctagatgaactaagaagagacacagttcaggtcagagtgcagctaggagtgaaaccccttgtggcactgtgggtacacctcggaggaagtgtgtgtgtttataagcatcttgtgtctacaagagcatcttgtgtccataagcttattgaagaaaagagctacatcaccaagatgcttcaatcctggacttttcatgcagaacatccagtatctggaaggtgttaagagtttccccaccccaaagtagctccaaaagaaagctgacaatctctaggggcagaaataatagcaagagccatctcttggcacctctggctgtagaatctcctcaagcagcagttttcaaagtttcaggactcatttatactcctcaaaattattcctttccaagtcctttccctgctcatggtgtttgtcacaaaggggactgagttctatagatgttatatgtgtaacatatctagcaacatcagtcgacacagataataaactgggatctgtgtttcctctacacatatgctcctcttaaacagtacattctcattaacttcagaaagttaacaacaacaaatggcaaaattagtacttttgacatgtaaaaatgcacatcataatcacagttttggtggagaacttatgctaaagtgagagtgatcatcttaattatataggagggtctcattagagcctcaagtatttaatctttagtgagattcagcatgagtgcaagagaactttgtgtggaaattagcatgtttggggattggaaaaagtaaaaatctactaggtgtacctgtgaacacacacatttcaaaaatcccatcaattgcagacacatacatcatcacttcaaagaaagcaacttaatactctgagcaaagcattgacaatgatatgcctgaacagacaggtttaattagcccaaacactgtgtgtcttaaaaaaggcaacacatgtcctcgagctttcttccacctcaacaaggctttataaaagcacatgtgtttgtttgtatataaactcacactgtcctgtgaaaattataatgtagtcatggagagggatgctaacagaaatggttaccacagcaacaaaaatcaccaccacactaaagatgtctgattctgtttcatctctcaggtttttgtcagaatggcttgctcaagttatccttcagcagtctagaagacagccctttcagcatgggactaccattattctcaatcacctgagcatagccataacttcacctgagtatagtcataactacaaagtctttgggtaggaaattttactggatacctggatcagataaatctatactgcccattagaatggatgctatctgaaaagagggcttttcccgttttgttcattggtgagccactgttatctaggataatgcccgacacatactaggtgctcaacatttgttaaatatataaatgatcactgtattagtctgttctcatgctgctctaagggcatacctgagactgggtaatttacaaaggaaagaggtttaattggctcacagttaagcaagacttgggaggcctcaggaaacttacaattatggcggaaggggaagcaaacatgtccttcttcacatggtggcagaagagagaagtgcagagcaaagaggggaagagcacctcataaaaccatcatatctcatgagaactcactcactatcatgagaaccacatggccaaaattgcccccatgattcaattacctcccactgggtccctcccacaacactcgggggttatgggcactacaattcaagacgaaatctgggtggggatacaaagcctaaccatatcaatcaccatgaaaaacacagcataaattaaaatcccagctgaaatctctctatttcatttttaaatcacaacacccaggatttgagtcaaaaaaactcaatatttcaatatgcttagaaggaaacaactccaaatgagattcctttgcaacacagtttgattctttatccctttcagttataattaagtcattcaattgaagtaggacagtacaatggttaagtgcatggactctggaacaataatgtcaggatgtgaaaccaggctctatctccttatagccttgaagggaccacttgacttctgtgtaccccagtgtctccatctgaaaaacagggagagtaatgggacctatctcaaacatcagctattaccatttgagcacacactatagctacaaagatgaataaaacatccttgagttcttattataccaccccccacagggtatcacagatcttgttacatgtctaacaagacagcaggaggacagaggtacaattatcagacagtcttccattgtctcaactctgccaaaccctggtggctggggctcgacaacttggtcactgagaaactaaggctggcaagtaggcatgtggactcaccttttgacattctctggcatagcatggaaaagaagaaatgcaagggacttgagtgtcaccaagctaacaatgctgaaagacaggaattagtacatctccttcttcactctgccagatcctggaataagtagcagcacattccattccagcctacttaaaatgggagcagcacagtcttagccgatgatcaaagacaaaagatctagaagttagaatttcaagactctccaagctggttgctccaacgttagaaaagtctatgcataacaggaaaaaggttggaactcaaattctgaaaaaaacttgattccaggtaagttaattcgtcataaaaataaaggaaagaaagggaaaagagaaactattatttaaagggttaacagtctagttgcctctcaagtattttctgaagccagtttagcagggttaaagtaatatatatgaacatattcttggcagagtatagtaaagaaatatgaaattatgcaaagacttgttgagattaaatgaattactgctgcatatgaatcagtcttttttaaagaagctatacagtataaaatagacacagtcttgtcattgattagatttacatttccatcttatttaagctatgccacctggagaataagataattcaatgcttttttatataaaacaccttggcttaatatttcacaatgagaaactttgattttgaattaaattatgacaaaatggaagtctaggagaatagaatattcagcatacaggatgctaaccattcaatctggtaaagatattgagtctctgacagtgaataactattgcaatgtacattttcctacaaatgagaagtagattcagaaactctaccaaacctttgaaaatcacacagcaaggcaggcatatattgccctatttttgtggttatgttgaggtatcaagtttctgcagcattcacgaagcccagaaatctctaaataatgccaccctcagttcattggtgatatctcaaaaatggctagagagaattattgtcttttatacatactgatccaaaagaaagctgtaatttctctaggacaccatccacaagtgtgctataaagcacaacttcaccagggttcctagaaacactgacgccctcagctcttgggggcctgggtagggtttcaggcacctagggacctcagaatggtctcttatcctacgagcatcttgatagggcttcaaatccccaggcaagtatcaccattatccgttatagccatggcatgcaaaagacgagaggcagaatggaacagataaagggagatggataaacaggttgagtatccctaatccaaaaatctgaaatccaatatgctccaaaatccaaaaaaaaaaaaaaaaaaatccaaaatctaaaacacttctggtcccaagcattccagatgaggaatattcaacctgtaattccacacaatgttaacaggaatttggaagaaaacaaaatatatgggatggagaaaattctgtggccaaatatgtgtaggaagtagtgagacaaagtaatagaaatttcttcactgtaggatttacaaaaattctttaacatgctgatagaacatgttaaaagaatatgatactgttgtaattcaacaacttatctgacagcacacttatttaaatggaattttaccagagttaggaattcacagaacacagtttgaaaaccactgctttacacatttgtgttacctgataaaaggacttcaataaacatttgagttacaatcgaattattatatatataaagaaacagggagttattccatttatttatttgtttttgaggtggggtcttgctatattgctcaggctggccttgaacttctgtgttcgagcaatcctccagcctcagcctcctgagtagttgggactacaggtgtgtgccattgcccctggctctatgggagttactccaaatgaagcttccaatgaggaagatattttatgataaactgaatgtaacctgggagatgtgagtaatatatgtgaatggcctaaattaattctgttattttacttctaaaatattccagatgcattcacacattgcttgtttccctttcttttgtttcaatcaatgagtaactatgagtgtctcctatatgctctaggcactgggacacccagtctccctcagagagacagacaagatggatcaacaaggtaggcaagacggagcttctattttcacagaggcagacagatgataggaaagcagatatatattattcagaagtgaaaattatgttatacttttaaggatgatatatcaatccgggtgatgtcagggagagtgactataggtggaaatttgggtgggagtactatttgagaagaaagtcaattagtacccccacccaaaatagaccaggaaacatttgtaaagggatatagtctgtttcctaatacaggtgcaggcaacttcaatgtaagctaacataatgtattgtcagaatagcattttccacactcaggaagggtctggaagtctggaaggctattctaaggaggtggcataggaactgtgtctgggaccatgagaaggcatcagtcaagaaagatctagggaaggagattcccatatgaggcaaatgacaggagcaaatgctttgagatggaaatgagcttggggaaaactcagaacaggatgattggagctggagcaccctgtgaggcgcagaaggtggcctaagatgagctggagatgcaaagagagacagaccacgtgggatcatagagcccatggtatggaatttggatctttgtctgcaggaagctgctcagcagttttcagcaggaaagtgctatgacatgatttctgttgttaaaaacagctgctgctgtgtgggaaacagcaagaagaaaagctgaaaagatgaagagaagtaattcacccctaaacatggtaagttacttcctcaaaccccagggcctaaaattccaaatcctggagaaataagtcaaactagatagtcattcagctaagcaaagagcaggtgttctgtggcacagctgaacttttacccttcaaacagtattgtcagaagagaaacaactgtcccaaagaaatgatgcaaagaaaaaaccgtattttttaaaaaattattttgtctaggacaccactattcttaacactttttttaaaaaatcttaaaggaacttggggataaaacttttttaactgcataagcactattcctctagtagaacttgagtgtgtaatgaagccaattgttttttaaaatagtaaggctttactgtgattcctaatcaatactcatatgacatctcctcacaaaatgatcatttactgtgtttaataactcttgagattaaataggaatgacatgcagtaaaacctgactaattttgatctgattaaatcaagttttgcaaaaatttggacctggcatggtctgaatctgtgttctgcattatccaataaaaacaaatctgtcctacaaattagcagttaacaaaaaatggaacggggggggggggggggatgatattcactctgaagaaaacaagccatctacaagtatattcatataggaccaacacactaattataaactgcttatctattcctgacagcaggtcactccaaaatctctattacattatgtaagcatacgttgaggttgcctgcacctacattggtaaacaaactatattcatttaaaaatatttcctggctgaaagttctcaatgacttcagctaacaatacagttaggatcaaagtttgaggttggctaaaatcacatgaaatcactatgtatgagcattttgggtataatactatgcacagtagacaatataaaacataaaacatatatattttatacagtcatttaagatttggttttatctgaatgtctaagtggactaacttccagccaaaggtttagaaacaacactgaatctaactcagggaagagccactgccaatcctgctttactaaacattacaaccactacccagcaaggccaaattccttgagcaaatgtgtgtttgctgaccctggaacccatctttgaagctccccatcgctaatgaaaagtgaactctacttcctgaccttttcagctgttctgggaatccagccataaccagagtctcccaagagaatctctgaatttgtctactgcaaatacagcactgcaatctaagcaggaaactgaactagattttaaaacaagccgttagcaacaaaaggcagaacattaaaatcaccatgtaatacaatcctgctaccactgacctttggttatataagtagttcagaatgacttgattgaataagagatgctgtattactttctttctgtgactaaacattttggggcctcatgttcaattagaaattaaaatttggccacacataccaagagtctaattacatttctcagcatctgtctttctttccaggccaaaagaaaatatttatgaagagcagattgagacaaaatatactgctgtggaattggtgaatatctccattacatcatttgccttttaggtggtttatcagttaggaatgcttttggctgcaaataagagaatctttgcattaagagtagcttaaacagttagtggcttatttatctcacaaaatctggaagtgatccctggggttgcttcagctcttcaacaatgctataaaaaaaaatggcttccaccattctcagcatgtgaattttcttccccaagcctgtcacctcattttcacaagatgctactacctttccaagcaacatatcctcatttaaagcaggaagcaggagacaggggcgaaatgactatcttcatgagtatccatcatctttactaaggaagggaatctcttctacttcccctcacgtctcattggccagagctgggtcgcatatacaactctagaccagtcactggtgtggcagaatggactgacgagactggcttagaccaactgtgattcacgacgtatgacctgggacaggcctgctttgcctgagatcaagtaattgtgctgactagacacaaaatcaggggtcagttagcgggaacagggagagatgctactgaggagataaggacagcactgtaacccacaaatgtttcctagaatggaaagatctacggataaacaaatgaataaatggtcactaaaagaaaaaagtaatagttcatttttgttttctctacagcaaaatattgtgagaggctgaagtgttgtcagagctgtagaacagaatctgttattgtctaactctccccacccccccggggtttttgtttttttttttctttttaataagtgaaatggttacctccattgtagttttgccaaattcaatgaaaagaatcacaatgaatcaagttacctctagaggcatcttctagcccccaaatttagttactggataactcaaaaggtaaccaccgtgcaacagggcatttcttccagtttccctgaagggtgatcaaaatgtccatttaaaacatataacccataccccatgatttaatgactggtatataagtaaaaggctgaacttacaaatactctcaagagagaaaccctgtcttcagaatgtaatagctttggagcaaatatgggaatgtttgtttgccatgtcagacatacataaaaggaattttcgtgctatggctaaaaacaccatcacacagtccaccttaaaacttggctccagtcgggttaaatagaattctaacagcatttaaggaaatctatgaccaggcatgatggctcacacctataattccagcactttgggaggctgaggtgggtggattacttgagtccagaagttcaagaccagcctgggcaacacagtgaagccctatctcttaaaaaaaaaaaaaaaaattagctgagcatggtggtgcatgcctgtagtcccagctactggggcggctgaggtgggagattcacttgagcctgggaagtcgaggctgcagtgagctgtgattgtaccactgcactccagcctgggtgacagagtgagactctgtctcaaaaaatttaaaaaaaaaaaaaaaaagaaagaaagaaatttacattatcatgcataaatcaggcatttttagtgctttaaataataaatggcgctctgaaaattcagcctaaaagcaagctgtgcttatttatccccaggattcgaagactgatactaagaagaatgttaaatgtggatagtagccagaattggaatataaggtgtaatctccattcttgctaagtttacaagcacaggaaagaatgagggtctaaattttagaaactgttgtgtacaatattgtcagagttgattacttgtggttctgatataatactgggatactgaaatgtcgcaattaaacaattctattttaagtattatgaatatttttcccctttaaattatatagcttcttggtagaaaacattcacgtatcaatttagcaaattagcccctgctgaactgttcagaaataaaacgaattcagtctctgcataaagaagagggcaccaacctcagagagataacagaatctagagaagaaaagttcctgcctcttttcaatgtctgtgtgctaggattgcagtccaggtgctctgcacttaggtaaaacacacagacaagccagatttggctactctcatttacaagacatgaaaacttgcaaagactttgtacacaaacccacttctcattagactgatccttggggatactgataagcagtaactagtgaagagtacaacctcatccttcctgccacactttccaagagctcccaggattagctgtgcgagaaagggaaagaaacggtttctgaatcatttcaaaccaccagcatccttccccagactctctaacatcaagctgctctctgctaccctctagaggatatcagcattacaacagtaaagaagaaagactgctaatcacagcgcggcacttacctagaaaacaagaatgtgaagttgaatagaatgaggattccttcaatataatatacaaaactcttttgagacttctgtttttagtatcaactatcataacaaaattatgcaaaaatcctgctacagattatacatcacaattaagcaaaagttatgcatatcttccctcattccccaagtctgatccacttcctggagtttgtactaactcaaagcattaaactatatgctaagaagtatctttaaggtctggcaaaaaaactatgactctgattcttgaattcattgatgagaaactcaaatgagaaaaatgaactaggtgtaaaatatcagggaatgatgaggactgtggcaaactggggaatctcctgccccattaatggggtaagaatctattaagttcttgctgattgtctggactcagggttccaagatcacttgttttttctgtcattgttgtgggttttttgtttttgtttgttttttttgagatggagttttgctcccaagctggagtgcaatgagtgcaatggcgcgatcttggctcactgcaacctccgcctcctgggttcaagcaattctcctgcctcagcctcccgagtagctgggatcacaggcacctgccaccacgccccgctaattttttgtatttttagtagaaatgggatttcaccatgttagccaggctagtctcgaactcctgacctcaggtgatccgcccacctcagcctcccaaagtgctgggattacaggcgtgagccaccgtgcccagctgtgttttgtgtttttaaatgaaaagccagaaaattaattgtatgtaaaaatctctatattttagaatgtttgacctcaaaacactgtaataagaaaaacaaataatgaaatatcttgaagatttagcccatcagagcagacatttctgctctaagattatctgtcagtggcaactgcaatccaagagaaaaaccagagaaggaaacctcatccatctctcacacaatgagagtcatcctatcaaaaaaccatctggtttatagggacagatgtagcagatgtggtaatttgaagaccgtttaaatcttcagccagtcccttccttggatgtttgatcttaatcttgaaacaaagtggctatattatatggcatattaaggcataaataaatcactgcaaccatctaggatatttcttccttgcctgctcagtccagaagcacagaagatagtcagatggacacttccaagaagggaatggaagcaatgaaaccaccttcacatgtttgtaggaggccatgtcactacagctgttgttaatccactcccagggaagggcaatgcaggtttgctgtttaacaccgaaattcctgctctaattctgagtgttacttttctccatcttgggtctgatttaaaatccaatctactcctcctatcactataatgtccctttctgaggtccatttatctttctcaaaaagaagaacatcgtctcagtcgatttttcccatggctgacagggtttggagaacagatatagcagatgaggatgccaactcatttttcatttgcaggttaaaaacattatcttgactgggtgcagtgactcacacctgtaatctcagcaccttgggaggctgaggcaggaggtgggaggaaggcttgatcccaggagttcgagcaccctgagcaacacagggagaccctgcctctacaaaaatttaaagacttggccaggtatggtggcacttgcctgtagccctagctactttggagactgaggcaggaggatctcttgagcccaggaggtcgaggcagcagtgagccgtgatcatgccacagcactttagcctgggcaacagagtgagaccctgtcaagaaaaaaaaaaaaagaaagaagagaaagaaagagagaaagaggaagagagagaaagaaagagagaaagagagagggggagagagagaaagagagaaagaaagagagagagggagagagagagagagagggagagagagaaactgtcttgtctacataaccttcattatcattagtcaaatctctatttcaacagcattgaaaactctttagtgactgtttccaacacaaatatatgactgctgaagattcctgaaggaagcagagttgttaaaatctaacaataagcgagtcctcttgaatgtgtgtatggatttattataaatttccagggaagctaaatccagtgtcacatctagataaacagcaggaggggaggacagagaaggaaatggtggggggaggggaggtgaagagatgggaggtgaggggaggagaagggaggaagagagcggaggggaggggagggggaaggaagacaaatcctaaaattatcctatagatcattacaattcacataaaagcttctctctattaaaaaagaaagtatatacctatgcatacaattgagttacttgagaatctggcaaaagacccttattatttaataataaattactcctgaaacacaaagctaaatttaaatatctatgaatgtcatttaacctctgaagatgtttcatcaaatacatattggaatcatgctgtattcctagcatttaatttttttcttgaaaatgaatgaataagagccatgtagactgctttaaaatttcactttatagattgctgtctgcaagtgttctaataatagacaaatggaaacagaagttaaggatttttgggggggttctcattttaaaagtggataaagcctgtttttaaaagtgtgtctgcacgtgtgtgtgtgtgtgtgtgtgtacaggagatcaacagaaaatataaatattggaggtgattcctaaggttatgcaagatggtgagacctacataagaaccaataagatgagtgagatcagcgagattccattaagttgatctatcatgtaatattgtcaacagatccagggcaatctgaagcctccacagatggtcagacagcactgaatttggtattcacggctcttgctagggatccgtccaacccagtgaatgatccttgagctagtataaaaatgcaacccccaggccccacagcagcacctcagttatcattattatcaacaacctactgaagacaaaaagaaaagcaacatgtgctgaccaaggaggctccacagttaaagattctccctctgctaagtttcacttacaacaaaaaaaatttgacttgccaatacacatatattaacattgatgtccgctgccgctcattaaatgcttagaatgtgccaggttatcaagcactttacaggcaccatgtcaataactgaagcctctgtgaggaccattcttacctccacagtcagatttcatagaggcccatggagattagatagcctgatcaaagttctactcccagtgagtgcccgagcagcaatctgaacccacatcttcatctctaaagacactgctcttgcctgagacactccaacaattaaatctcccagacgcagaattttcagaagtaacactgatatttttgaaagtgaattcagagagccgaaggttcattctctgttaccatcattcaattctcttatggttttctatgggtcttgccaaaagagcactttgatttctatcattctatttccaacctgtaagaaaagttcccagcaaaagtagcagcttcatctatgtgggatcttccagtggtgacttttagatcaatggagttccaggtgacaagaacagagactccttttaaaagaatgctatttgtattagtcagggctctccagagaaacagaaccaataggacatatatatacagatatataagaagaagtttatttataggaattggctcacatgactggctcatgtgaattggccaaggagtcccacaatatgctgtctgcaagctaaagaaccaagaaaactggtggtatatttcaatccatgatggtataaactcccaatccaagccagaaggcttgagaacctggggtgggtaagggcagcactggtataaatcctccagagaccgaagacccagaaaccaagagctccaatgtccaagggcaggagaagatgggtgtcccagctcaagaagagagaacaagttcgcccttcctccatatttgtgttctatccaggccagcaaaggactggatgatgcccatccacattggtgatggcagatcttctttactcagtttattgattcaaatgcaaacctcttccagaaacactcttacagatacacccagaaataatgttttaccagctacctgggaatctcttaacccagtcaagatgacacacaaaattaaccatctcactattaatttcaaaggcaacttcattcctagaataccacaaacacctttgtgcccaccagccagaactgattgttaatactgtcacacttgcatcaagacttttttttttttttctttttgagacggagtctcgctctgtccctaggctggagtgcagtggcgcgatctcggctcactacaagctccacctcctgggttcacaccattctcctgcctcagcctcctgagtagctgggactacaggcaccgccaccacgcctggctaattttttgtatttttagtagagacggggtttcaccgtgttatagccaggatggtctcaatctcctgacctcgtgatccacctgcctcagcctcccaaagtgctgggattacaggcgtaagccactgcgcccagcgcatcaagacttttaaaatgaatggatggatggacagatggacggacgggtggatggatggacagatggatggatgaataaatcagccttaaatttaatgaataaaagcaacttcttccagtaaagaacaagtcaatgtttggaactaattaatttattcaccaggtatgccctgagttagaatccagcaatgtgctaaatactggggatacaacaggaaataagacaataatgtaacattgttccaatacaggaaaggagagagcattgtgggagcatggcaggtggtagctcactcacaatcactggctgccatatggtgcccggttttccaatacttccaagaggcagaaaataaagattttacatgggtaggtggctggggtcaaaccacaaaggtccaggctaatcacgtcaaattacaaccaatgaaagattttaaatgaggaagtgagatcactaaattctactttatcaacattactctacccacatatggcaaatgggttggaaggggtgaagatggaagcctgaagtttcacttaaccaattaccgaaaacaacacacacacacctctctccacacacacacacgccattagcgcattaaacctgcctcattaggactcctaaaatcagattccacattcccttacaatattctaacttgaaaataaaaactcactgtaggcaactagtgctttcaaagccctccagttttccttcctctttgtgctaatggctttaggccacatctcactgcaggagcaaagtgtttaaatcacaacaggtttgcactgacagtggcactcatcccatcaatatcctcagagaatacttatacaggcatagctcacagatactgtgggttcggttcctgatgaccgccataaagtgaatattgcaataaagcaggtcacataaattttttggttttccagcacatataaaagttatatttaaacttttgccatcctcctgcctcagcctcctgagttgctaggactataggcatgggccaccaccccaagccaatttaaaaaaaaaatttttttgtggagatgtggtctcattgtattgccaggctgcactgaaactcctggcctcaagtgatcctccaaccttagcctccccaagcactgggattataagcttgagccatcacacccagccacaaatgttcttaatggcctctagaatggtaaattgtttccagaagattttcaacttactttgaccagatccatagaagaatcactatctacggcagctatagctttacaaaatgtatttcttaaataataagacttgaaagtttaagtgactccttgatccatgggctgcagaagggatgctgtgttaacaggcacgaaaacaacattcatctccatgtacatctccatcagagctcttgggtgaccaggtgccttgtcgatgagtagcagtaacaatacattgaaaggaatcttttttcttctgaggaagtaggtctcaacaagggcttaaaatattcagtaaaacatgctataagcagatgtgctatcattcaggctttgttattccatatatagagcacaggcagagtagatttagcaccctctttaaggccctagaatcttcagaatagtcaatgagcattggcttcaacttcaagtcaccagctacgttaccacctaacaagagactgagtctgtcctttgaagttttgaagccaggcattgacttctcctctctagctaggaaagtcctggacaacatattcttccaatagaaggctgtttcatccgcactgaaaatctgttgtttagtatagccacattcatcaattatcttagcttgatctcctgcataccttgctgtagcttctacaatagtacttgctgctgcatcttgcacttttatgttataaaaacagcttctttccttaaacttcatgaaccaacttataggccagcttcaaacttttcttctgcagcttcctcacctctcagccttcattcacagaactggggagttagggccttgctctggatcaggctttggcttaaggaaatgttgtacctggtttaatcttctatccagaccaactttctccacattagcaataaggatgttgcactttcttgccattcgtgtgcttactggaatagcccttttaatttgccgccagaactcttccctttgcattcacaacttagttaactgtttggttcaagaggcctagctttcagccgctctcagctttccacatgccttcctcattcagcttaatcatctctagcttttgatttaaagtgagagatgtgtgactcttcctttctctcaaacacttaaagagtccattgcagggtattaattgacttaatttcaatactgttgtggctcacggaatagggaggccccaggagagggagagagacatgggaaagggggatccgtggagcagtcagaacacacacaacacttattaagtttgccatcttatatgggtatagtttgtggcaccctgaaattacaacagtaacatcagagataaatgatcacagatcaccaagacagacagaacaaggaaaaagtttaaatattgtgagaattaccaaaacgtgactcaaagacacaaggtgaccacatgctgttggaaaaatggcaccaatagacttgggcaatgcaaagttgccacaaaccttcaagttgtaaaaaaaaaaatgcagtatctgcaaagtgcaatagagggacacaatcaaaaggatgtgcctggaatggctttcaagcactagtttatctgaagcctctgataggaatgtgcattcagtatgcatgcgtactcccacacaccctcaaacacacagaaacataacaacccatattcatttttctgccaggaaacaccacaaatcaatttccactagtgtctttttggtttttaaaacaatttactggactgataatgatgctaataatattttctgggcactggtcatcgtgtgagggacattactacattatcttaatttaatgctcccacaaatcctaggaggttagtataattactatccccattgtaccactgcaaaaaccagtgcttggaattgttaatgagcttgcaaaggtcatacacccagtaaactgagatattgggatctgaacctggaaagcccaaatctgaaccctttgtttctaacagccatgcctacttgcctcttccagggaaggtgaacagggcagtgataagggtgtctggctgtagggccacacattattttcacatttactgttaaggtctcaggaaaatcccagtgatagtggggagaaacgatggaaaacttaattactgttcattattttgcatcggttaagaaataatctactctcaactgttatcaatagacattctgaaaacttcaggaaacctctatctctataaaaccactgctttcagccactaaggtcaggtcgtgaaaaaatacatattaagatttaaaaatttaaggcacatagtgctaagtaaataaaaatccacttgtaaatatgtgaccccatttttgtatgcacacatccacaaacactagaaaatataaacaaaaatgttcagccattaactttgagatcactatttttccttctttatgcttttctatctttcctaagtatttcagatttactgtttttgtaatgggggaaatatgattcaatgacagctttgggtgaatagtgagaagagtttaatgccttttgggctgcttctgaaatgcacattttgaagctccttctataatcatgtaaacaacatcaaagactatggttatgaccagagagaacttgatcaactgtggaaactgcagttccatcaaaataaaagaggttgctattattgatttttttttttttttaaatggagtctcactctgtcccccaggctggagtgcagtggcgcgatctcggctcactgcaacctccgcctcccaggttcacgccattctcccacctcagcgtcccaagtagctgggactacagatgcccgccaccacgcttggctaattttttgtatttttagtagagacagggtttcaccgtgttagccaggatggactcagtctcctgacctcctgatccgcccgcctcggcctcccaaagtgctgggattacaggcctgagccgccacgcctggcctattgctttatttattaagctacaacatttgatgagcacatttgatgaaataaaaagttcttgttgttggctcctgcagttgtgtcaatctttaaaatttacaaaagaacttaaaaacctaacagggagtaattctatcttccttgagctacaatttgcagagtttttaaagaagccacgttgagaagactcattttaaaccatgcttctgtactgggataagttaatggctttaatgctgaggaatataccctaggatcacaacatgtcatagacatcaaaggatgtgtttcatttgtgaataaaatttattatacatcagcagaaagctttcaacaaggagatccacactctagaaaatccacgaacatggagacccaatccaggctgcagacagttaatccccacgaccaattttaatcacccattcattcaacaaataactaataagtgtcatgcccggaactaggtacagcctaatgaggacagcatagaggaggtgccaccttgacagagtaggatgtttggaatccactggaatgcagtctacaaaatgaatactacgtggctttcattgcccttgttcactcgcatggggatatgatatttaaatatatttatatcaaaatgcttagaattctacaatatttaacactgtatcaagtccaagaagaacaaaggctgttcttcaaagtttcctgttgttgcatatcaataacaaaaacaacagcaacagcaggccttactttggagcactttcaatgaatcaggttccctgccaaatattttacatcattatttcattaattttaagaaaaaaattcttagaactcctgcgcccatgttttgagacaatgaatgcatctttttccccattatgaaaatccaatatacccagagcctgcttctcattttaatgaatacttttttatgtagagcaagtaagggcttcagagccagacacatcagaatgtgacttggggctccaccatgaatgttcatatgggctttggggcaagctctgtggtctctgagcctctctgtcctcatcgctgaaataaagaccccagtcgcttttcccagaattcttcagacgattaaaggagatattgtgtgtgagtgaatgtgtctgtgcattccccagtgtctgctggggtgcatgcacaacagctgactttattcaagacgccacctacaaccacactacttcatgcgctctcaaccttttactgaattccatttccaatgaactgtcctaagactcatatctgatttccacaggattctgctgagctggtaaccttctctttccctgcatctgtgaaaacctacagcatttgtcatacagtcaatcagaatgtaggaaacaggcttaagaagatgctgttaattgcagaaacctgctgatcaacaatatgtctgggaaatgtttgcaaacaaaccctgaaacatctgtccacataaaagtctgaaaacagatatgaaaattagcttttgaagaaaggagtaaatgggagacagggttaaataaacttcattctatcaattgcttaaaaaaaaagaaagagaccctacatgacttctctctacaaagacatctgcatattttcctggatgctagatacgtctaggcatacaaagatgattcataccacatcatctcattatcactcttgagatcacttgttaaaataaataatgtatcttttttcccatggtgataatattcatattctaatgttaaaagttcagtcctttcaaaatccattcatttgctcaactttataccaagcttttactatgtgcctgatactataaaatcaggatatagtctagaagattcctaagtgtttgtccaccaagttctttatattccaccatcttccttctaaatcacccaagaaaaatatctctgaagcagtcctcatctctgccagtatttaaaatatctaggccgggcgtggtggctcatgtctgtaatcccagaactctgggaggccaaggtgggcagatcacctgaggtcagtagttcgagaccagcctggccaacatggtgaaatctcatctctaataaaaatacaaaaaattagccgggcgtggtggcataggcctgtaatcccagcttactcgggaggctgaggcaggagaattgcttgaacctgggaggcagaggctgcagtgagctgagattgtgccactgcactccagcctgggtgacagagcaagactccatctcaaaaaaaaaaaaagtctaaaagaaaagtctattcgtgtcactaagggttttgttaaagtaattatttattttttctgtctctagggtatatttaacacatattcattttttgtgttggttctcaagtcttgagtggaacacattttaatataataaaataaagtctggggaaaattaatttacacataaagataatatatactcaccaagacaccatgattatgtgtgggctttgttattctaaaactttaaaataaaaaaaaaaagtgagacttaacattccttcattagactcctaataaggggatgtatttgggtgttttgttttgttcttgggaatgaaaatttcaaattgttcattacatttcaaatcagtttttaggaaaggccaaaagcttcatgggtatctccctaatagagaaaaacagtgaaagctaacttttaaaatgtgcttctaacagtttgttcatggccaggtttcttctagctagttttcaggtttcagaactaaatgccccatatcagagaattttaggaccagatgaatagtatagaatctatagatcacccaatgtctctcaaaatatatcacagagaactggtttgcataggttagacgatgtgactccagattttgaaccccattactggcttctacctccctccgagggcccaaagtataactggcacatagcaaatgctcagtaaatgtttgctgaataaatgaaatggggaagtcagcataacaagaataggctgagaaagattatagtggcactgttttaaatgaatgagtctggttagaatgaaatcttaagtagctgaccaggctgatgcaaaggttccaatcgtatggaaacatgcttaagaaagaagactgaattaaagaagatatagactgattttatagaagatatagactatattatactctaggatcctaatttcaatgataagaaagactgtcaggaaatgtttttgttttctgttttttttaataaaggtaagaaaaagatgcgaaagtattaacagtgaaatctccgaggggtgggattatggacaactttgttttccctttttaaaaattacattaacatatataaaacgaaatttgccatcttaaccattcttaagtatgtaattcagtggcattagtaacatttacaacattatacaattatcactactatctatctttttcatcacctggaagagaaattctttaactataaggcaataaattccccattctgtccctccctccagccctttggcaacctctagtctccatcctgtctctctgaatttgcccattctagatcttccatacaagcagaatcatacagtgttggtccttttgcatctggcatatttaacttagcataatgttttcaaggtttttccacaagtgattttttggaaaactattttcgcatattaaattattttttacaatggaaatgttatatacagggaaccagaatgctttgtgtctcaaataaggtgtaagctacagagaaacagaagcaggaaagagaaggtatctcaagcaggaggaatgagacaggcaaaggggcacagggcagaggacagacagtgcccccagaatggcacagggagtggtgtcaaggattagtggtcagtaagtcagactgcacctctgaaatcagcctagcagataaccaagatcatcttgcacagttcttaccacaagatccaatccactgacaaaaatacagagcgtattacttacaattggaagccctaacttcgcaggcaagcatattttgcatgaattggcaggttacaaatgaacataagaagacagcatctgtcaagtcccttaggaaaccaggcagaaccaaatgtaattccttacctgaaaaacataaacacataacacacattaaaattcaataggcaaattttatgcctttcttagtaatttaagacatatgtttaatcaattatttctttttctcattgcaaggtgcctacggcaagtggatattgaattctcttttgtttttccccccttgaggtagagtctcgctctgtggcccaggctggagtacaatggcacaatcttggctcactgcaacctcagactcccaggctcatgcagtcctcccactttggcctcccagtagctgggattacacgtgtgcactatcatgcccagctaattttttgtattttttatagagacagggatttgccatgttgcccaggctggtctcgaactcctggcctaaagtgatctacccacctcagcttcccaaagtgctgggattgcaggcatgagccactgcacctggccagatactgaattcttttctttttttagatggagtcttgctctgtcacccaggctgcagtacagtggcacaatctcagctcactgcaacctctgcctcccaggttcaagcgattctccttcctcagcctcccaactagctgggactacaggcacctgccaccacgcctggctaatttttgtatttttagtagagacagggttttaatatgttggccaggctggtctcaaactcctgaccttgtgatctgcctgccttggccttccaaagtgctgggattacaggtgtgagccaccacgtccagccctgaattcttaattcaatgcatatttttccctgattcaagactaatttgatgtaaatgtttctatataggatgataaattctcctatataggatgataaatgtttctgatgcaagtatatggagtcactatatcaaacataactcagaaataactatatcattgacagtataattagtcatttccaggacataacaatcacataatcaaatggaccctaaagtcctacttgacatctcatccaacccctgaattcacccgtcctcttcttgggtatctatccattcactcggcacatctagtgagcacaaactacccttgctgatgacatggaggggaaaagcatgattccagccatcaagggcattaaaatataatatagaaataaactatattcaagcctcttccctcttcactggtgaatatctggaaaataattatattactttgtactgcttctgcctagtcaatcactgactcagtaagtatattcagagcatttctctgggctaggaatacataatacagcagcaaacagagccccatctctggccttggggaacttacagtctagtagcaaatacacatattttagtacaagcacatgtaatgggaaggccaaacagggtgatctagtctgggctaatggaagacgccttgatgaggcacatttagagtgagatctaagccaggcgtggtggccaatgtctgacattccagctattcaggaggctgaggcaggacgaatgtgtgaggccaggaagtcaaagccagcctgagcaacaaagtaagaccgtgtctcagtcacctaaaggatgaataagagttaaaggaaagcatcatttaggtgtatgaaagtggttctcaaactgtgtttaggggaccctctgaggagtcttaacactttttcaggagatacataagctcaaaaccattacttaatcatgcaaagatgtacatgcccttttcactctcatcttacagttatgttttccagaggctacaggcctgaaggcagaagcagcaatgagaacccagctgccctacattaaaccagactgcccagagatggccaaacatctaacaaaattccactcttctcactaaatatttagttctagaaactatttctttaaaaaatattacttatgttaatacataatagggatattattgtaatttttttaaatgaattaatacacatttgtaatttctcaatttccatttctaaaaaggtaaatatgcagggaataaaagctctttggtgtcctcgagtatatttaagagtccagaggggtgaactgtggacttcagttaagtgatgtgttgatatagattcatcaatggtaacaaatgtcccacaataatgcaagatgttaagaagagaaactgcgggagaggaggagaaggcgtccatggagactctactttctgcgccatcttcctgctaaacctaaaactgctctaaaaaataaggtctatttaagggggaaaaaaagagtctaaaagaatgtcaagaccaaaaagtttgagaaccactggcctacagaaaggcagaagcaaagccagcgggcgaggcaggggtggtgggcagagaagccagtgagccaaatgctgggaaaccaagactcggggtgccagtaattaggaccagaatgtggctctaaacacagtttttaaaaagatattgcttcacagcattcctgccagaaacaggactcctcctctctccgaaactgatgatagctaagagggacaaggaaaacctaagagtctcagaggcagtcaggctccaagcatgggccagggtgctccttagtagccaaatttagacatgaagatttttcaagtttgctcttattttattcctaaaggaattaaggtgtagttgttattttaatatctattaggtaacaaaaactgccctcaaagagttgctgagaacagtgacattaagcaggccccatgcccactttcttgtgtgtcaagtagaacactaaaactgtgagccacaggaatattctgattctcaagttcaagtcttttggggatgattaatgcaaagcccagggtaggatatgggcctttagatgttctggctctgctctaagttaagattttctaaaactgagcaggaacccccagagagtccagaatagaaggaaagttatgtatctattcaaaggataagaatttgcagctgccgctttgtattgcaacacagtgaggggcaggctaggttcacctgtccttccattgtttcagctgatacttattaaacacctactgtgtgccacatctgatgtcaaggagctggtgaccaagttgtaggaagagatttaaaaaacaggccacatttatacagcttgacacatgtaataagagagataaagaaaggatgctatgggcccccaaaaagaaggacatgagaggcatgacctcctgggggagttattgtcaaaatcaaggcctggtgggggattgatgtttggccaggttagtaaacagtggggtatacagcacttaagactggtgaaatgacacggacaaaagggcagaaacaacacaggatcccaaagcagccctgggaagggggataacattggaggcaggagagtaataggggtggcaatggtgatccagatggtatcctcaaacaggccagcggcagtaggggtggacagtagatgtgttaaaactgacagagctcaggcactactataaatggaggtataggaggaataagaggaacacagcacagccatccaattctctacagtgggagagttgatgggcttccaagacttcatcatgttaagatgcaaggcactcagtggtagccagcaaacctcagagatcatgatagtgaaggttaaatgaagagagtgcccaatgtctgtaagtgcatgatgcaattcataagagctgttgttactgttaccatagctatccttataactgagcatccatcaaataaggtgaaggtgatgtgattctatgtaaaacatgaccaaaatcagttgcaaaactgttctgtggcaacctggatgagatgggaggctattattctaagtgaagtgactcaggaatggaaaaccaaacatcatacgttctcactcataagtgggagctaagctatgaggatgcaaaggtataagaatgacacaatggactttggggactcaaggggaaaggatgggaagcggatgagggataaaagactacaaactgggtccagtgtatactgcttgcatgatgggtgcaccaaaatctcagaaatcaccactaaaaaacctactcatgtaaccaaataccatctgttcccccaaaaacctatgggaataaaataaatatataaaaccaggtctagtctgagttaaaaaaaaaaaaaaaaaactgctgtgggccaatcattcgttatgcaaatgaggttgagggttatagccagtagaaatgatacgctgaatcaaatgctgaccaagcaaacaaaagtggaggcctcaagatatgttctggaatccttatttttaaaaagaggttttgtttggccttcccaagcaagatccagatgatacagagcttactttttccacctactccataatgcagggggaagcatttaaactcaaaatgatggtgcaatgagagatggggtcaggaaggctgcagcacaacaaacgaggaaaacccaaactcctggtggccaaggctctggttaagggcaggcagagcagaaaggggttcctgagggtgctgaggctgggacacattctgcaaattaaaaccaaatggcataaatccactggcaaacaccaaaacaagatggtcccgtaattggcaaaataatagtttgggaccccaaagcaaccatcctataattctggtcactgtgctgatggagggcaggaacagaaatctggagaacctaaaaggagttacatatgtgatgaggaggttgggaaaacgggctttttaaaaagggaacaagtaccagggatttatacgtacagtggtgagaaagggatctttaatgatgcttctcaagtagaaatgcatctccctctaagaaaaaatctaccattacaatcaaattaacaagctagatgaactgtagaatgagttcacaaagtttacaaaatacctaacaatatagttactctaaatagtgatttgatttgtttaacaaatactggttcacacacattttagaaacatatgcaatgtaattagtgactatgggaatcaaaactctgagaagtcaaattttgctgtgtaaatcagaagttctccaaagcagtcaacgaatagcctacatttccctcacctgaggtaaaatgcttactttggagtccaatcccaaatctataacattagaatctcgggtttcatgaatgtgtattttttacaagttccccgcaaggtattttacatacgctgaaagttgaaagccaccaagggagagcaagtagaccttgtaggaagggctcttacatattaactcttctcaatcaacatacgaaacatagtactacttgaaatttttgcaggaaaagaaagaatattacagtgctaggtgtcatgagacattaaagtaagttaccaaagtggcttgaaacctttctttatataagatgcaccaggcaagtgattcaacttctctgaacctgtttcctcatctttaaaatggggattaaaaacagtttcagaaatttgtgatgagggttgacccagctaatgtgtttattgtgtgcacacgtgcctggcactgggaaacagcttggtgagtataagctataattatttgggggaaacatctgattaaaaccctaaaactagtcctgcattcaaaagatgagaaaggtatcgatcccatttctgcccttactctagctcagagacctgaaataaatgtaaagatccttcagctggaggcttctcatgaagaaagaaattgtcctgccccctgctgggcaatggtgcactgacagaaagagcctgagaaatgttcccggcatcacagccaggctggagcattcccattgtgtggcagggtcagcttcaaagagcacacagtgtctctccctttgtctacttttgatgtctcttttcaatctaacattatgatgttgcattgaccttcggagaaaagggcactgttctacacggttctgataagccgctttctaaaaaacacttcctggatgctagcagtatggacttcttaccaagaggacaagacaataatcttgtcatttaatagaggccttaggaaagagagagatgacaaaggcagtttccaaatgtcactgaagaatggtctttgcaagtatcactgagtcaaatgtgggcagtgtgtatgtaaggatgtatgtgtgcagatttacatatgcatgtgcattccatatatatgtgctctctctgaagaaaatatattaaaactctacattcaattttatagtttaaaagatatacaatatttagagtcaaaagacttgatctccatccaattttaaaaaatttccttctttattctattcttttacaaacagaatttcttatggaagaactttttaaaaagctacttatccttaaagatatcgtctgattttttcgtttgtttgttttttggaaacggggtcttgctatggcacccacgctggagtgcagtggcacaatctcagctcactgcagccttgacttcccaggctcaagccatcatcccgcctcagcccctccaagtagctgggactacaggcgcaactcacaaggcctggctaaatttttttttgtattttttgtacaaacagggtttcaccatgttgtccaggctggttgcaaactcctgcactcaagcaacgtgccctccttggcctcccaaagtgctgggattacaagagtgacccactgcaaagatacttagaagtagctttaagatcagattcaaaactcagcctctgttgtttactttaatatggtgttaggtaagtaacttagcctctctaaggtttaattttcttctataagatgaggaaatgcctacttaggtttggtgtgaggaataaataaaataatgcatgggaaagtgctttataattggtaaccaatcaaatcaatgtaatttaatgtcaaaattaatgacataattaatccaaaatggttgttctccacaaaacgttaaaaataatcttgtaaaattacatctataatctcagaggtataatttctaagcatacagaagcaagctactaaggttatggtgtcatgcaggcatgtatttttggttgaggacaaggccttgatgtgtgttcacaaagactctctacttgatcaaactttagtctggttcctatgagccctctttttggactaggcctcaaccttaacccctgtcctgtctttggctggccagcccagtcttagcaaagaatcctactcagtcatatcccaccccgacttcaatccttgacatcttatcatcttggcctgctttcagcaagaatcctgttaggtcagtgcagccaaaatctttctacctctgatatctcctcttagtcattttccacccactgacctcccctcacaccctcccttgctcattagctataaatcccacttgtcctggctgtattcaaagttgagcctgatctccctcctctactgtaatacccctattacagcagtcctcagtaaagtcttcctgaccattttgacaagtgtcagaatgatttttttcctcaacaatgtctaaaagagaaatagggaaagaaggaggaacttacgtcatagtgcaacaccaaagatggcagagaccgagatgagaaaatctgggaagatctgtatatcctgaactgaaactgagtgcccgagaaccacagggatgcattgcaaatacacacactcagctcactttgtgagacctaaactgtccaggctcgtcagaatttgtggtattatagacactctgccatcatcaacccaatgagaaagctgagaaaaacaccaatacgaagcactctcctgcatattatctcactgaatcttcaccaaaaacacctatgaactgagtatggttattatctccattttattggtaaagaaactaagagttaaaaaagcaatctgtcacgcctgtaatcccagcattttgggaggccgaggcgggaggatcacctgaggttcaggagttcgagaccagcctgaccaacacagtgaaaccccatctctactaaaaatacaaaatcagccagtcgtggtggcacatgcctgtaatcccagctactcgggaggctgaggcagcagaatcacttgagctcgggaggcagaggttccagtgagccaagatcgcaccaccacaaactccatctcaaaaaaaaaaaaaaaaaagtaatctgtacccatgttatgtagctggcaagtgaaagagtctagactcaaccccaggcaagttgattccaaagcccattcttttaatcaccacacaaaactgcctcccaggaagtaatatccaggagaaagaaaagtaaagttgaaattctaggaaaagcagaagggcccagaaggagcgaaccacctaactttcggatcataggcatgggaaaggaccacacagctgcaggtatagactgtagagaatgtctgactgaacacagtgtgtaaagaatgaataacttattgtgccctctgcattagttataattatacaaaatctttctcattgatcttagggattcccaaagaactttcttcaattccccatcctcattttctgtttgcttgaaatctatcacatgatagatattgctaaaatatagtgactttttaccaatgattttaaaggataaaagcaaaatccacaattccttcttatcactgagagacagaattttgattaccgcaacaaagaatcaagcaaatatgccacgatctgatgtaaaaacaatggcacatttacgattaatttccatcctcattcaagtgatgtaggaaaaaaataatgagctaattactgaagaaaggaaaaaataactatctaaaacatctatcaaggacttatagggcacaggaaaattcattcctgtgctcattttatgctcactcacttgttttggtccccagatttctgtgtgtaatatcacttttcaagatcaagaaagttattccataagcctttgaaacaagtatcttattagatgtatttcatgattcactttctgatgttgagcctgcctttttatcactgccactttcaaaggcaatgtcttaaggaaaatagtttcgtgtacactgggttttccccttaaaggcagtgctagttttaggcagctaaaagaaccaaagctttggagaaggcccactgggttttcaaatagtttattctcactatttcaaaccaaatatgccaagttacaaatgaacatatggcaacatcttagccaaccagtttggattactgtccaaatcggagactaaatcttggagattaaacttaatttggagtaagtatcagctagttttctatgtttaaaaggaagttatctttcatacaaagagaggtgaggaaggggctggccaattaaataactgttacaccacaaatagtatatttatttatttattattttttaaatttttttttttttgagatggaatctcactctgtcaccaaggctggagtgcagtggtgtgatcttggctcactgcaacctccatgtcctgggttccagcaattctcctatctccctagtagctgggattacaggcgcgtgccacgaggcccagctaatttttgtacttttagtagagatagggttttaccatgttggccaggctggtctcaaactgctgacctcaggtgatctgcccgccccagcctcccaaagtgctgggattacaggtgtgagccaccgcgctcggccacaaatagtacatttgcattatatcagctaatgtttacaattcacccaaggaggtagttatttctgacaatcaaagagaaaaagcttagaaagcttaagtcattcagacatgttcagggtcatatctgatatgatccaacccatactctttgctctatacctttggtctctgatatcagaatattcactcaagcatgtgaaagtgtatctgaattaaaaatcactattttgtatagagtacttcgggggcaagggaacagtgggggtggtaattagaattcatttcttctagacagtctgtgataggattcagcatcaagtggtaggaatttacacataggcatataaaatgaataagtcttctaagaaaatgtaaatgagacccaaggttacaactatatatgtttatggccttcaggaaggttagcataatgctgtagtattttctcatgtgaataatgaaactaacttacccacaattgagtaagcctaaaaaaaattcaggcaacagctattctgcaaagttaccattattattaaaataaaatcttattaacctcatgccaactcatttcagatagttctaatttaagaaaactgttaccctgcaggcaaccttatgcattatcatgctgcaatataaacactgaataatctaaacctagataaatcaaaatctgtcatttctgatcacttacatttcaaattcatagtcttaaccatttcttacttctagataagctctccccttaagtctttaaaataatttcaactttcacaatgaaagattccaaagattttctataactgggaacaactacacaatgttcgtgaagttaaaaattatcgtgtcggggcttatagacttctctcttttccaacttagttcgctctgtaattgatcccctcttacagagaagaaaagggacaatttgatgtagttttccacttagtggatccctgagaaaaaaataaagagttagagactaaactcttctaaagatggccagtggggaaaaaaattgtgtgcatttttacacagcataaataagttaaatggtggtgcatgtcggtgtggatgagaacaatgttctcacaagtgatggggatctaaagaaaagagaagctgcaagatttcggtaaaagttgcatgtactagtaaatttagaacactttaaatagctcataaaaacatgagcaaaggtcatacttctcatggggaccctgcttatttaaataaaaccctgccctaagacagaacaggagcatggctttataaatgatatatgttcatcccagcgtctggctcctggtgtcagcagaggtctctactgtaacaagtctttcataagcatctctgtacatcctgagatatgtcctttgccaactgtacacactctgaagtgcattatggtgccacagtctcttcctgtaaactacctttatgaaaaattacagtcatatttccagatgacatattcggaagtcatcaggagacagtcttaccttcaatacagagtgttcagagaatagagttaaaatgaaagctatacagcctcaactaaaacaacagaatacccacatacacaaacacaccatcatacaaggaagacactttattacctatccctgatgaaaaacagaattcctctggtaatgaacttacatctgaacccatacacggaatgccaaatttgaaagtattttagttaaagaaaataactcaaataccatactgaaataattcttttcagacacttaagaaaacatactgcagaatctcataatctatcacagctttgggttgctacctccttgccgggaggtttataaaatcactcaagagcccttctcaaattatgtagctttccatttgctactttttaacagtaacttggagagaaaaatatatttgattgtctatgttaactcttttaattttcactgagtttgagggcacaagaagcactgacttataaccattccagaggaccaaaactggaggccagggaccttctatagaaaagaggttttctgaaattttacaataaactccattgtagctatataaccagtggtcacatttttcaaaaatgtaccataaattaaatttctggccgggtatggtggctcacgcctgtaatcccaacacattgggaggctgaggcaagtggatcacctgatgttcaagaccagcctggccaacatggcgaaatcccatctctactaaaaatacaaaaattagctgggcacggtggtgcacacctgtaatcccagctacttgggaggctaaggcaggagaattgcttgaacccaggaggcagaggttgcagtgagccaagatcacaccattgcactccagcctgggcaacagagccagacttcatctcaataaattattaatttctataaatagaaccataccctcctaatgacttaaaccatcttctcagaagtgtttcagtttatgcaggaactattaactgcttcaacttttaggtttgtcagccacatgatttaaagaaagaaatcctaaaataaattatttgagaaattaagtactcatttctgctttctctggtttataaagttaagacattcattggtttagaaagcaagacaaacttcaattttaactaaatgtatcacccaatttcccttaaacaatagagacacataatcttctctagagagatactttagagcatttcttctctttccagaaacttccttcaggaaaaactggcttgagagacccatttctgtgatgtcacagcatcttacacacacagagctctaaggcacctcaaatcctagggtcaaattaactgggttctaaccaaaacaacaacaacactcgctgacttcaaaggtctgttgactcgaggagataaatctcccagtcctagttggttcttttcagagaggtgcagaaaagaccccctagaatggagctgttgagccaatcacctttccacagcaagacataaagcggagcatctggggagagaaataaagcttacaaacaaaactcggggaaaggagaaagagaaaggtcattcgtccttttcaaagatgcttacttacactgttgattttattatattcaaaactacccaaatatcagacatccagtctgactgctcttttcttttaatcacttggagctcatttctgaaaatagcactctggtcctcagtgagccagattttgcaaactgcccatacattcccgttatcacattttacccagtctgcagcatattcataatatgttaagtaaattaatttccaatatatattcccaaagcagcggttctcaactgggggggaatatcatgccccaggagacatctggcaacgtctggagacattattggttgtcacaaatggaggatgctactggcatctagtgggtagagaccagggatactgctaaataccctacaatgcacaggacagcccctacaacaagaagtattcggcctcaaatatggcaaggttgagaaactgtgagaaatcaattaataatatttttgttgccttcattcaatgagggcagtgtttctcaaaaacgtaaactttctgactccaaactctttactgactccaacaaacacctccaagaattctgaaaaataggcaaatgtttacttagtccccacattttaaaaataagatactcaaggaacatatatgctggtgaatgttagaattcaaatgttaaatccatctaatccttgcaagctttctcatatatgatctcatacatattttctttaccacagccccagaaaggagaactgttaggcccagtgcaaaaaaaaaaaaaaaaaaaaaaaaaaaaaatggaaagtgaaactgaaggaagtcaaaagcaacttatctagtgtctcccgatgggttagcaggagagcaaggaatcggatcaagtccctaattttagtgttgttcttctcaatacatgatgccctcctctaggacagtttttaaaatattgaactgagctgctaaaattgtaaccatctcatccaatgccatatattcatggatgtcatttaacccgcctaagtgccagtctccttatctataaaatggggatgtgttgtgaggaatagaggagataatgttccttacatctgtgcttagcacaaaagaagcactcaactagaaaaggcagctgctcttgttattcttattactgggatctcaggacaatgtgtgtcattataccagaacagtatttaagcaagcaaccaaaaggttgggatagaaaacccaacatacaaaaaaagcatctactgcaaaatactatctatctcagccagcagcagtgggtggggggtagaagaggctgatttcaagttatatggagcacaagaccgaacaaacagaagtcttgaacatttacttgcatttatttccttttctgttattaaaggcataaaagaaaggtcttcatttcaacgtcatggggcaatgctgggactaacaagtttgtgcttgaatgtgagatgtgttccagtaaaactgatagagtctatacctccttatttaaagaggtagtgaagaggtgagaaagattcaaaagggggcccatttttatttgagtgatatagcactgaaattaagattcggggctctagaattagcctggattcaaattttggctctagtgtgtaactagccctgactattagaaagctacacaacctttctaaccttcactttcctgagcaaaaattggagagcacgaaagtatttccttcatgtaatagaattgtgttggaagtcaaatggtataatgcaggtcaaactctcaacatagggtctggaatactgcacatggaaaataaatgctaaccactgttactatgattgttgtcatcattgtcttcaacttcctcctcctcctcctcctcctcctcctccccgtcctcctttataatgtccagctctatgtctagctcacaggaggttcacaataaatgtctgctgattaataattgtttatgacacactagatactgctctaagaggcagttactactattattctctttttaaaaggaagaaactggggaccagaaaggataagaaacttgcccaaggtcacacggcaaggaagtaacagagcggtaattttttttttttttttaagagatggggtcttgttctgtcacccaggctggagtgcagtggcacactcatagctcacagcatcctaaaactcctaggctcaagcgacaggaacacaggaatatagaagataggaatagatagcaacataagacaggaatacaggcacacaccactacgcccaactaattgttttatttgttgtaaagacggggtctccctatgttgcccagtctggtctcaaactcctagcctcaagtgatcctcttcctttggtcctcaaagaggtagggttacaggcacgagccactggcccagcctagagttataatttgagcccagatggtcaggccgcaaagcctctgtccctagctaccacacaacactgccttatgatagaagaagagtgaaaaacagggtttaaggaagttctcatcaacataaaatctcaacagatgagacccatctgagaaggagggaaagaaaccacactcctgagatggccagtcagagggaggcttcgtagaaacacttctttgaaacaaggggtagaggtaggcaggaaagagtctttgcatgcaatgagcttgtttgccattttaaacatatgtagcgcccatagacggataggtaccctgaagacagaatcagagatcccaaacactgaagttacgcagatatctgaggatgaaagaaggggacccttccacaggatagatgcagctgaacaacttatgtgatctggaatcttcaagtcctcttgactttcaccaggcacattcaatttccagagcgccctgggatgtactaggcaaaagatggtatgttttagggaaaacagctctcagacatcccaacttaacatccatacacatttgccacctgattgtgaactaaattacagggtaataattatcagatacgagattaaaatggaagattcttgtcctgcccaactaaagaggacaaatggagtcaaatgaagaatactgttagacatttttataaaggataaattatatttccaatagacctagtaccagtcttgtcaagtaaggactcttcagaactgcagcaaaatgctaaattccaacaacgttaagccatttcctacagtaattacatgaggtttcatttctaacctctccaaacgcttttatgtctgtctcttttctagtggcaaacgcagggaggttaagaggagcaagccattttgtttcaagccagccacaaaccaaatgcacaatgccacaaaagaagtctttattccatcagccagcgggttcctcattaaccagccgagaatgaacctagaatgcacaatttcgtgttaatcacagaaaacagatgcccatgatggctgcaggtaaaactgattgtttttgcctctcagtaccactcactagggaatgtgatctgtttcatctccaccctcccttcaaggattgctgagctcccaagtgcttgtgaaaacacgtcaggtgtggggatggtactgtgagaaatgaaaaatggtcctgacaagatgaaaagctgcattttccatcttgttcttaaatgggcttaaatagacacaaaatggggactgcttaacccttccatatccacacctcaatagagcagactggagtaagagcctaaaaagttttcaggaggtcagcagggtgggggtgggaactgcctcattttttctttatggtaactcactatccagggctcacaataccccagaatggctgcatttcactaggtataagccacttccagcacccagcgcctgccaggagggcagtctatgaacaatcacagctcaagtggttcctttccccctccaacgagaatcacaaatgcctcctgaagtgggtcccactaacagttcagctccttgaacacccatttcttccttctcagattttgaaagtctaaatagttggttagtgatgataaaggagatacatgtagcagaggcgacttgcaaggcattaattcattctccgaacaccagcctctcctacgaatctcattactgcacagcaggtggacaagtgaagtacaaagaatgggaaggcggaaaaaaaaaacaggaagaaaaaacacacagatctccaaaggatgccatcattattttacattataatgatcccaagaaaagggtgaactactcattgttcatttgttcattcactggagaatcataagcagggcccagggaaacaaaaatgctatcagtaacaataattactttgtttctatttgtttctttagttatataacatgggtgtgttattataggttaggcactctgctaagtcctctacatgattttctcattgaattcttacaccacccactgacataggtattactgtttttcctgttctacagatgaggaaactgaggtcctcagaaattgagtatctcaaaaggtcacacagctagtaagtggctcagataggactgaaactctggtctgcacagtaattcatacaagcgtcactctaccacttccagaatgtggtctaaatgcaggcacaactttatatacaaggatattcattgcaacataatctggaaccaataatggaaacaacacctgtttcccaaagtagggatggtacattttttgaaccatcactactactttggggaacagccattcaaggggatatctgcagtgcaagaggctctctgaccccactcttttccttcctgaaagcagtgataaaacccccatgtgcaagtatcctccctatactagtaggaaagtcacattcgtatcatcaaggatgggaagctgagaccaagagagttctgtataaacagaccttgttaaaataattcttaccttccttcattctccctacataattcagttacttttccagaattgcctctctgtgttcaaccaaatataaaagtatctaggttttgccacttccttagatctatatttccatataagggttcccatgtcacaaaagacttatattacataaatttgtaagcttttctcctgtgactctcacagtgctttaattctcaggcctggctgaaaaaaactaggaaggtgaaggtaaaagtttgcctatcctacaataacaacatttacatagcacacatcacttatcaagcactttttctatagtaactcatttaatcctcaaaacaaccccagaaaactgaggcataaagaaaaaaaataatgttcccaagtcacaaagctgctaagcacaagggctggattccaacccagactgtctgaatgggatatctgtgcgcataagcatttccctacactaatggtaacaaaatagcacagtcttctaggtggaagcataggcatatttcatatcgcacaagtgcttttaaaaaaaaaaaagaaataaataaaagaaaatcctgaggccaggcacagtggctcatatctgtaatcccagcactttgggaggctgaggcgggaggatcacttgagcacaggagttcaagaccagcctgggcaacatggagaaaccccatctctacaaataaataaaaaaattagccaggtgtggtcgctggcacctttagtgccagctactggggaggctgaggtgagaggatcactttaccctcggaggtggaggttgcagtgagccaagaccatacctctgcactccagcatggatgacagaacaagaccctgtctcaaaagaaaaaaagaaaaaaaaaaaaaaaaccttgttgttcaaaagaattatagtttgggtattaacatggtctatggtcttccgtttccttttatgatcaacatgaaatccttaaatacagtaataaaaatttctagttccacacccacccacccaccataaaaaagaatgtagacgtgaaaatggcatgatacttaatgatcaagagattctcaggtaaaaatgtaaagcaagccagcatgatattacttatggttgtgattcattctctatgcttctcccactcctgtccactcccctctcccccactattcaaaaaggaaaggaaaagctggatgtctagctctgacattgcaagggttgctgatattctattttactatgtttgctatgttttcaaaagaaccaacattttagaagaaaaggaacatcagtttatttaatttggttcttcactttttactctaaatcaaagttcaatttaccttaaagttttaaaaaaggctgacagctgaggccttttggaaagatcacctcactctacagaatgcttaggggaaaaattcatcaaaagcagacagcagacatctaccatccaccataaatcagcttcctttttctttttctttttttttctttaagcatcttctttagaatacagtgagaaagtcgtgtcatttaacttggctttttgaaaggaatttcagaaattattttagtttctggaataagcataggcgtaaacacacagattcagtatatgcctgaagcttgttgatttctcctagatatttaaaaacagaaccgcttgttttgtcctttttcacttggctcacaaagtgacatggcaacagactatgtactaattttctggggtttcagcactgaaccaagaagatggcagaaaaatggatacaatcattaaagaaattataggaactaaattaagtcaacctaacagtgaggctgattttcataaagggcctgtgtccccaaggtaaggaatgcatccttcccatcatggaagtcaatggatggcacctaacatggtgtcctcagtgctacagaatttatctaacattatctgacttgcctgttcccattaaaagtataacatatgtgatcaactgttgtagaataaaaacatttggcaaagacaatgaatcctacttataggtctggttttgggaatgaacctttaccaaaggaggggaaaggctactgatcccatgatcccataacaggattgccactaagcacttttttatttgaggtaaggccaagcatttggttgtggcactggcgggacaactataaagaaaccaatgttccactgcttattaagctccagagtctcattaatgccctttacaaacttaggagaggtgtactactctaccttacataataaagaaaattgaattttaaaacattgaagtcatttatccaaagtcgtttagctagagagttggaagagtcaggattcgggcccaggacaacctaataccagatacatgaggctgtggtgcctttcctctaaccttaagttgctttgagaagtttgagctcctgctctttagaaatattcaaccagaggctgtatggccttttggaattaattttgtaaagaacttaatcactggctggggaatgctagtgattccttccccatgaaatctactgatatttccattatatgagtcaatggacagtcttcaacatgggttgccattttcggatttctctgtctttctcaatcttgcttctaagcaaggcaatgattcttcctatacaaaagtcactttctgcaatatctgcctaaatttttaaaacatttgtgaaccctggtagtgtcaccaaaacatctgctgacctaactaaataatttcatctgatcatcccagcctcggtcccatctgtggctttcttctccctgcttattaagttgagatgagtaggcaggactaaagtatccctaacattttcctgcttgtttatttaacagctatggatatttacatttgccttcctaacatatttggtattaattaaaactcacagatttagcacagctctttctatatataaggcacaagtcaacaaactaatcttcaaaaaaacttcatttgggtaaagtgggggataccttcttcaactcagaaatcgggagtttaataagctaaggctacattcaatgtagtatgttatatagaacaagggagaaggagtcccaattcctggcctggtggacaacagctagaatatacccaagctattgtgattctttccgggtaccatattttaggaggaacataaactagattgtttccaaagaggatgtggataatagaaattcgaaactacgttgcaagggattgtacagctattctccatgttggtcaggctggtctcaaactcttgacctcaggtgatccgcttgcttaggcctccgaaagtgctgggattacaggcatgagccacggcccttggccgcaagaattatcttaatcacagtcattattataacagaataagaggctgggtgcggtggctcacgcctgtaatcccaacactttgggaggtcaaggcaggtagatcacttgaggtcatgagtttgagactagcctggccaatctggtgaaaccctgtctctactaaaaataaaaaattagccaggtgtgatggcaggcacctgtaatctcagctactcaggaggctgaggcaggagaatcgcttaaacctgggaggcagaggttgcagtgagccgagatcacaccaccgcactccagcctgggtgacagagcgagactccatctcaaatagtaataataacaacagaataagagaaagcacactagcctgaggataaaagatgcttgggttctagtccgaatttggttggtaacaaactaccgtcttgggcaggtcatattgccctctctgagtttccatttctctctcttttttcttacataagtgcatggtctagattaggtagcaggaatgacagaatcatgacacgcaaaatcaatctgcacacatgttctgtctggctagcatgaactctccagatcatcaagtctgcctctctatttatcaataatcacctattcacacatttaacttacctgcctgacccaagcaagagtgttatcccccaagttctattatatttcttacagatctaaaattatatatagtatctctttctgactcacccacagtttagttttttttttaataaagactttaggccagggcagtggctcatgcctgtaatcccagcactttgggaggccacattaggtagatcattagaggccaggagttcgagaccagcctggccaacatggtgaaatctcgtttctactaaaaacacagaaaagaaaaaagaaaaataaataaataaataaagactttactcaaagcattttcaaaattcctgtcatcctaaattggagaatagttttatagtatttagaaagctcaaagacattcatccttccctcaagaaagaacttcccctaaatgaagctctgacaattgttacatgaaatttacgttaggaggccattgttatggactgatctcctgcactaggccccaacagaacagaccaaaccaaaatggggttactcatgctaaggttccattcaccaaaacaaaatgaaagtgtctaagcttaggagaaatgacaaaaaagatgacagccaaatcctcaggcagttctagctggcatgaaagggaaatcacctctgctttaacccttacaggaaaagcaatctgatgtagcttaatgtaaaccaagccactttttgtattatgcaatttcattgttcctggcttaagctatcatataaaaactgaccattctgcatgcccaatggagtgccttttctaaatctttggatgtcatgctctccaattcatgaattgctactaaaagcaaataagatctttaaacttaatttgttgaaattttgtgttttaacacaaccaaaataggcaagcattctattcctactggcaaccctttacacaagttgcttaaaaaattacttaagcaggctgggtgtggtggctcatgcctgtaatcccagcactttgggaggctgaggcaggcagatcacttgaggttaggagttctagaccagcctggccaacttgacaaaacctcgtctctactaaaaatacaaaaattagccaggtatggtggtgcccacctgtagtcccaaatactcagggggctgaggcaggagaattacttgaacccggaaggcagaggttgcagtgagccaagatcacgccactggactccaacctacgtgacagagcaagattcaatctcaaaaaaaaaaagaaattacttaaggatactggtgccaccatattaaattcaagaagtggtaaagcaaaggttgcttgtctcagtcaagttttttcttcattgtttggcttcactaaagtaccaaaaataagactattgaaatcaaatagcagaaagttagaatgctttctaaaaaactaatcactcctgcaaggctcacataataacagccagctatgggtagaatgactttattcacatctattaataaatggcaaagatgaaatgcagcagtggaggctcagatttttccagttgtggtagaacacacaggagtcccagtttgaaccttcctacaatttaatttttaatatctctgctttagaaaatactacagtggcattactttaaagaaatcattatcttttagaaaatgtgaaaaatgtgtttaagaagataaaaactgctccgtacagagaataatattttcccctttaaactccagggacaaagcaaattttccagtgtcattttactgtagcccaccaggattttgacaaagcaaacctagtgctaagaaactccttgaaacttgaaaccagcaaagagcctcttggtaacttaaatagatgaatttcaattttaaagccactgggcctgaaaaaaaagaaatgcctttttaaaaaaattgcaaaatttgaactcaatattggctttcttactgaagaaaataataggaaaatattctttaaaagttgtcgatctgtttttttctgatgacaaaaataaataatgagtagacaaaaccaaatgattacttaggtatataatcctcatatatgcatataatggggtttttacttggttttcttttgatctttttataaaaatgagctcacattgcacatgcactttgaacttcctactgaaagttcataagcgtagtagagcatgatgttgtgtacctgtagtcccacctattcaggaggctgaggcaggaagatcatttgagaccaggagttttaggctgcagtaagctatgatcgcaccactgcactccagtctgggcaagagagcaagactctaagaaaaaaatataaaataaataaaaataaagttcatcaatatcacacaaagcctcctagaaataaacagtcccaggccccatccaggtacaagctgcaatttcacagcatttcaaggtgatggacatgcaattgaaaaatgaagaagccatagccgggaagatactttatggagcaccattccctatttgactttgatgataagatgtagatgttgataacacgtgtctctggacaccaaggaagataagtgtctacctgggtttaaaaatgtgcctactatctctatgtaacagtgcctgttaaaagcaaaaaaggtgagaaggcatcttcaagttcaggttttcggatagaaggtggctggaaagagctttcctttgttgcatcacttccccagtaaagtagcttgaataaccatcagtgagatagcctctcctgtcaaaacctccaactaaagtcacagtatccaacagggcccttgggcaaagatgttcactttcaaaattcaccatgaggagatttacgtgccatctgggaggattgctatcttgggcccatgatgctattactgctctcatgaaccttattactgagaggacaagaaaggtgagagaggcagaagaagacacatcactggcaaaaactgctctgtctgcttaccatgagtttattttagactcctgcctgcggaaatacaaccagtgtgtcaaggcctatgtggccattcagcatttcccagagactctatgacttctcctagttccaaagactgtctcatagaaaactaacatcagaattcccacttttttcatcaaaattggtcaagcactaattattaaaagtatgaaaaatgctaccatatgttcatcttttagttgccttctaggtaccgtagggcattggtgatttaagctcccatccatcctgccacgtgcaggaagaaactgacacgaggaaacccactggccagctcttgttctgataatgtccagcaacccttaataggggcaaggtactctacatgcctcagtttactcttgtgtaaatgatacctgtgtgcctcaagtgtttctcaaagtatgactcacaaaccatgagagctgagggacaggtatgaaagatgcttttaataggtaatgtgagcattagaaaaatattagatgtttgcatataggcgtatccttttttagtaaattattattcatttatttacttatttattttgaagtggagtctcgctctgtcaccaggctggagtgcagtggcacaatctcagctcactgcaacctctgactccctggttcaagctattctcctgcctcagcctcccaagtagctgggactacaggcatgtgccacaatgcctagctaatttgtttttctatttttagtagagacggggttttcccatgttggccaggatggtcttgatctcctaacctcgtgatccacccacctcggcctcccaaagtgctgggattacaaacgcaagccactacgcccagcaaattattttatttttaaagaagattactgggcagggtgtggtattacagattacacctgtaatcccagcgctttgggaggccaaggcgggcagatcacctgaggccaggagttcgagaccagcctggccaacatagcgaaaccccgtctctattaaaaacacaaaaattagccaggcatggtggcatgcacctgtagtcccagctactcaggaggctaaggcagaagaatcgcttgaacccaggaggcagaggttgcagtgagccgagattgcaccactgcactccagcctgggtgacagacagtgaatctgtctcaatgtctcaaaaaaaaaaaaagaagacgattactcagcaaatatcagctcagatagtaggtgaatatgaggtggaaagtcctaaaggtgtttcttaattatttcaggtagtatagcaccatgggcaagtgagtatctctttacagaacacagggaaacatagagatattttatttcatcataaataaagaaaattttataactgtgtaatataaaagcacaaccacagtttacatgtctgcaatttgtttaaaactagctatcaaaataaggtataaccagccttctccaaatgtgattaatagttatttgctatttagcttataatgttttatgttctgctagcattagaaagcaaataagctagtcagcacaaaaaattttgaaacctttaataaaaaacaaaatctaatggatttaattttattcaataagcctcatcattatttgactctccttcagcctaacccaggaatccccagtgctgtatggagcatgctatgagaagcagggactagttggagtctgaagtccattctatgaggctagatcatgtaagaccttaatttatggtttgactattttaaaagaatactgtggcatcttttataacctggccaggcgcggtggctcacgcctataatcccagcactttgggaggccgaggcgggtggatcacaaggtcaggagttcaagacaagcccggccaagatggtgaaaccctgtctctactaaaaatacaaaaatttgccagacttggtggtgggtgcctgtaatcccagggagagggtgaggcaggagaatcgtttgaacctgggaggcggaggttgcagtgaactgagatcatgccactgcactccagcttgagcgacagagcaagactccgtctcaagaaaaagaaaaagaaaaaaaagacaacaatataacctattaggcccaatcccttccttgtaggggccaatttcctctttcctcatcaaaacagagactttatgaacctgtgtctccctgttaacattgtcagaccatagagaaaagccattccttctttgtctcttctgcactgattcaggggggacttgagtacagctgtccatcatgagaccctggctttttcaccacaggagtgggcatgggacctgggatggccaatcaccaccaatgtaggcaaaagacctaactgagccaactgagttctctgcagagaatgatcatggtgctacaagggagggacacctctttccctgggatcagcagccataagaaggaagtaggccaggagctgccacatggagaacacttcgtgagagtgaagcaaacacagaggaagcaaacagggagcagagaaaaggaaaacgagacagcataaggataagcttcataaatcaggaagctaacaaacttcaggctcactgagggcagtattgcaggtaaatgagtctaagtttgggacaagacatgtttccagggacctggttttacgacccagttcctgattactgcacaggctgatgagaatttcttgcatttacaaatgacagaaaagatgcacagaaagcaattaacagcatgtgaatttaaggaggggaagcaatgggaggaggcaagaattgaaagactaccagatgaaagttaccaggaagcacagaggtcatgaggtctgcagaactgggtgaagatacagactccacctcacaccagcgtcctctttgatctaccacggaccagtttcctcatctggtaaatggcaaaaaaactctacctgcctggcaggactgttgtaagaaataaatgaaatcatatatgtaaagtattcataaaagtacctgacagagtagaaaaagagctctcaagttctcaccaaccctgaatcactatgatgtaggagtaatatattaaaacaacagccaacacccccaaaagattaacaaccttaagagtagggggtcgggcaccatggctcacacctgtaatccaagcactttggaaagctgaggcaggaagatcacttgagcccaggagttcaagactggtctagtcaacacagtgaaacctcatctccataaaaaattaaaaaattagtcaggcatggcagtgcatgcctgtagtcccagctactcaggtggctgaggcaggaagatcacttgagcctgggaggtggagtttgcagtgagctatgatggggccactgcactccagcctatgcaacagagcaagacactgtctcaaaaaaaagacaaaaaagagtgggggtgggatcactggtaggtaaactcagaatacactagcataaggtctatccatatcactcggattgtctggctgtgatgctaatgtatatgccttggaattctaagttacagtctccttgtttatcatctggaagttcacaagcctaccttctggagaacatggtgaattcagaaggaaaatgtaactgtactctaatttgctttctttgtgtctcagactgccttgattcgagtgtttatgccttaatcatacttgagtctttcattttaatgacttttttaattcgatataaagattaaaatttttatatctcattgtgttttccttttaatacaagttacttgtggttgctgaacaaggtacaaattagaacaatttcttcccgggaacgatatgaaggaaacttcacaggaagagaaaaaaattccaaaggataaacaggtttattacagaaattacacactacagattcccataatgctaaccatcccagtaactaagtggcacatgggcatctgtttccatagccccagatccactggctagttaaaaaaaaaaaaaaattaattgctaacaataaggttttgttctaacattgggtgaaacttttcctggttatgagtttctataactgacatataattccggctaaaccaaaattctgttttacacaagcaaagaagtcctgagcagggtgaaatggtagttatcatctttgatgttactgtcaaaggcgtggaagatacttatcttaataccactgttgtctccaccatcttcctgtgatgtttttcacccatgaatttattgaaaatgtatttgaaatgagcaaaaattgtgtcctgtatccctcttggataattagtttctgaagtccatgtttgttatatattcaaaatcttcctggggcaaaattctccttattttgaatgtccaggttttggtggaaaagaattcataataagtgctttcatactttccttataatcctgttggcttgtgtcccctaaaaactcagagtctaccaagcttttgttcacatagtttatggatatactgtgcacccattcttaaccctgacatttcacatctgcttgcctaagagaaatggcatacacaaaatgttttcctatttggtgatgaacaagtacatggaacatatagatcacaagtgatttttaagtaagaggaaaacaagaaattcaaccaaagagccaactagtactgggcctatgttctgtgcctaacaaggggttctaagatacactaactcgccttaggcaatagggagaagattttgatttctgtcttcactattgatagctacatgagtcaattacttagcctttctaagcttcagttataaagttaggataaaaatgttgtcaacatcatgggatagtagtgaaacaagacaatgtatatgaatttcatagtacccagcatacaataagagctcaataaatattggctatttttattatcatcatcattcttatcaacccaaagagccacatgaatgtaacctacagactgattgatctcaaatgcatttttttaattctaaaatttctgaaatcctatgaatataacaaagtattttcaggctgggcgtggtgactcccacctgtaatcccagcactttctgaggccaagacagatagattccttgagtccaggagtttcagaccagcctgggcaacatggcaaaaccccatctcaacaaaaaaatacaaaaaaatttgccaggcattgtcatacatgcctgtagtatcagctacttgggagactgaggcaggagtatcatttgagcctaggacttggaggttccagtaagcctagattgtgccattgcactccagcctgggcaacagagtgagaccttctctggaaaaaaaaaaaaaatttttttaagtgtttttttctcttctcacccactctgccaaaaaaaaaaaaaaaaaaaaaaaaaagcatcttaaagaaaacatagtccattatgtgaatggatatgcagacaaaaaatgtgcagttacatacaccaaagtattaactatgattatgaaaggtgatactatatagttctttttaacagtggtttctggtcaaacacagtagcccacacctgtaatcccagcattttcagaggcggaggtgggcgggttgcttgagccccaggagttcaagaccagcctgggaaacatggcaaaaccatgtctctaccaaaaatataaaaaattagctggacatggtggcacatgcctgtagtcccagctatgcaatggctgaagtgggaggatcacctgaacctgggaagctgaggctgcactgagccatgatcacatcactgcacttcagcctcagtcacagagtgagaccctgtctttaaaaaaaaaaaaaaaagtttctaattattctttgatgaatttaaattatttgcaaaacaaaaacattaaacaaacatttttgccataaatcccgtacttacttagtgtgccccaaatctagtcaaataaattactataagaattttttgttgtccttcctacttagtttgcaatttttgccactccttttgaaatagctcatcctcctgtcttctacataggtggtgcagaaagtattttaaaaatcaatgtagcattctttactacttgctatatgaaacactactggcatatagttgggtttctttttttttttttttatggcttctgaatgttttacattccattaattaaatcctactctcaattgtttttttaaaaaggccacacaaatattaatgtcaaaaaaaagtgattaggtaagagaatggaagatatatttccaaaaatttttcaaagcctctgagtcccaggaaacacaatttttaaaaatggtaacccttatttaaacacataataaaaagagatcttgtcaaatatattaaattataaattggacatcagttttgtacaggctgatttctaaactgtaatagaacacatctggggtgattttctggctctcctcgaatatctggttttccaggcagctgcaggaaatctctgggtagacataccactacaataattaatgccagctttcaggcatcccaatgaaaaagaattcatgacagcaacagaaaacggtactccccccgcaacacacacacagaataaccacgaatttaatgtaaaacatgaatccacaggcctccagcctggagcagctgaaagacatttgtgtgatttgtgtgattcatgaacaaagagtcattcgatctcttccatcagacttttctgcatctcagccacttttgtttctatccatcgctggctgcttcattcataccctggttatgtctgcactgaacagggctccctatttctattatactacaggttccaacaaggaaccttcttctaccctctccttgctttcatctttcatctccctgaagggcactggggcctagcacagcacctggaacatagcagatgcccaaccaaggctgtgggtagatggactgtagggtaagtgagcatgtgcaaggataaagaatgtatgaacaaaacgcaaacagtgaaaactcaaagactttctggattctaaaattatatttattaagggaaatattcgacttttgagaagcaaacatacagataatgtgctcactagctgtgtgacctcagagaagttccttagcctctctgggcttcagttttctcatctataaaattgagaccctaacagtgcctaatcaagtggttgctgtgagggttaaattagtcaccatttgtgatgtacttagacgaatgactggaaaatactatgtgtcaagaaaaaaagtaagtactgacaaataaatatcaggttcattatcaccattttactaaaataaagggactatatttggcataaataccaaatggacttgaaaaccgtgctcatggcaaagtgcggttgcttacacctgtaattccagcactttgggaggccaaggtgggaggatcacttgagcctgggaggttgaggctgcagtgagccatgattgttgtgccactgcactccagcctgggcaacagagtgagactcttatcacaaaaaaaaaaaaaaaagaaagaaagaaagaaaaagaaaagggaaaagaaaaatatgttcggtctcctaaaagatagaaaacaaatgtatatagctggtttcaaatcccacctatttgactgcagtgctgtgtaatttctggacctccgtgtgaacaatttgtaaatggaattatcatagttcccattgcatacgttttctgtgaaagattaaattaaattatataaaaaatttagcaagaaaactggcatgcagtaaacaatcaataatcctaactaacactactatagttctattagagagtgtggtaaatcatgattaaataggtatgcataataattcatatggtgggcatcatttattcagacatcaaatacttaatgagtacatacatcatattaggccattttagatactgtattctttaaagccccacaacagccatgtgatacacagtttacagcactaacttaatgaagaaaatattaatttaaaaagaaaagttcggccaggtgcagtgactcacgcctgtaatcccagcactttggggggccaaggctggcggatcacctgaggtaaggagttcaagatcaggctggccaacatggtgaaactttgtctctactgaaaatacaaaaattagctgggcatggtggcgggtgcctgtaatcccagcttcttgggaggctgaggcaggagaatcgcttgaacccaggaggcagaggttgcagtgggccaagatagtgccattgcattccagcctgggcaacaagagtgaaactctgtctcaaaaaaaaaaaaaataaataaataagtcttttgagaaatgcaggaagggttcaaagggaagataacatttgttgaatatccagcacattccaagccccatatagtgccctttacatatgcaatctgtgtcctcactccacacccagaagatggggaccatgacttcaattgcacaggtgaggaaacagcagttaagcaacttgccaggaccactcaggtcaaagagccacagttcaaacttagacctacctggcttttgactctagatttctgcccaacttcttaatatttgccaaacagaaaaatactaagatgactgaagccagtcaaaatgtgtcttcacttttaatgacttttaaaaagacaactcgcatcttggatcaagttcctattaataattttccaaagattccaatatactccagaggtcctcaaccagggacagttataccccccaggggacatttggggatgtccagagacattaatggttatcacaattaggaaggtgctagtgtcatctaggggtcgagaccagggatactgctaaataacttgcaacacacagaacagctgcctgctcccaaaccccagacaatgaattatccagtccaaaatgtcaccagtgcataggaaaagaaaccctgtagcaacccacaaaatgaaaattttttgactttccaaaagttgtactttgcttagtcatgctctagaattccacaggaataaccacttagcctcactcattttttttcttcactattaagtttacgcttcagtacacattactgccagtatgacctcttccatcacacccagggctctggcagcgttaatgtgagtggccctcttctccatgtaaatgtgcacaaatagaatattctggtctcaagagaacacaagcaagtcccaaatttgcttctggaagggctcagcccaaggtaagaagggccgggaggggactatatcagatgccatacactaaagcactcaacttttttccaaaaataattcatcttcaacccagcaatgcagttttctttgcctgtgtgttcttgcataaggaactgtgagatgatttaaaaagcaaactttagaaaggtaaagttgaatctcagaactttctaagaccaagaattgcacaatcgcttgacagatttatcccctaatttgatagcctctgccccttcccagaaaaactcaactaaagatttataagtctacttagatgaaaagttctcctgtggcaacacaaggcttcttttaaagtaacagtctaatagtctaatgaattttattcgcaccatggagagaaagatcttgattccttaaggtctccaaaaaagatctatctttggaaagtgacgagtatgctgttaagcaaaagcagtagcaagtaactctaacctttttcttaccagctagttcctgttatcgattacatgtgatgggaacatttactatcatgaaaataacagcactaacaaagaaaaaaaaatgacacttgtaacacagtccttagtttcctaacacatttgacaaacttgaaaagggggtggtcctgagatctgagaacatgctatcaattttttggggggggaagggcaggggggacatcatctcactctgtggcccaggctggagtggactggtgcaattacggctcactgcagcctggacattgtgggctcaggtgatcctcccacctcagccttctaagtagctgtggactacaagtatgcaccaccagccctggctaatttttgtactttttgtagtgactgtgttttgccatgttgcccaggctggtctcaaactcccaggctcaagtgatccccccgcttcaatctcccaaagtgctgggattacaggagtgacacatcacgcccagcctatgctgtcatcttaagatatactgattaatttcagtcaatgcttaattctgaaattaccaacttggcctaaatacttgcaaaagcactgaagaagatttaaagcaaaagttctataaccacagtactaaggagattcaaacgactaacaatgaggtccaaaactattgagagaagagccctggagagctaacttgcatatgtattcacagaaagtctcaatactcaaactcaatattacacagggtcagaaatggttaacagctgacttaaagtttcctctttgagtgaagaatccatttttgaaaaaaaattttaacattaaaaataaatcattactttgatccaacagatgaataagccccctatacagtttatgctcatttgcagacttgattataaaaaacgtaggaaaattaaggaaggatggccaccacattatcaaccatgggttacagaagggggttgatgagaaggaaaagaatctagcccacatggggcagaagaagggatttgcactgcttatggtatactatgtaagggccatgactacgggtgatttttctgttttatgtttcactactttgcatattgtattttttaaaagtttggatgggctgggcatggtggctcacgcctataatcctagcacattgggaggccaaggcaggcagaccagtctggccaacatagtgaaaccccatctctactaaaaatataaaacttagccaggcgttgtggctcatgcctgtaattccaactacccaggaggctgaggcaggagaattgctggaatctgggaggcggaggctgcagagagccaagatcatgccactgcactccagcctgagtgacagatcaagattctgtctcaaaaaaaaaaagaacaaaatttaaaagttaaaagttcggatggaaaacagaatagtacctgcacacagagccttcccaaacagatactgacacaatacaagatatctgacagcattcattgagtatacttacatgtgctaggcagtagttgctaatggctccatttgatcatctgaacatttgattgtttcatcttcgcaaatgcctatctaccttgatcaggaaatggatagatttttttttaagttccggagtacatgtgcaggatgtacaggtttgttatatataaacacgtacgtggtggtttgctgcatggaataggttttttaaaactaaatacagtagtggtttgtttcacagaaatagattcatttaaaaaattattatacaaattatatagcaactgccgcttttcaaagaccaaagatataatgaaattgacttgacattaaactcgtattatagataattcagttttcatctcatggctgagaggccattacaagatcctaaatagcttctggccaataatggcaacatctataataataacagctaccacggaagagatttgctaaaggtttctactgattctctcattaatctccatcaccctgactctgcaactacgcaaacacagagagtacaggcagctttcctgaagtcagtcagtggaagtctgaaccatctgactggggaaccccccctcactataaacctaagattgttctgtaaaaacagactcgctggtaaacagaggggtctcctgagcagattggtagatttcactttcccatatattctgggggatggcatgcatttcatgtccatttatcacatgtcccaagtctagagaccctaactatcaaagggaaacacttgtcaatcacagattgtagaaattatcattagtaagcataataggcagaataatcaccccaaagatatccccatcctgcttcccagaacctgtgactatgttacatgacaaaggggaattaaggtcactaattatggtgacctttaaataggattatctgggtgggcccaatataatcataagcatctgtaaaagataagactgtagatgaatggcacagaaggatacaacgttgctagcaggctttgaagatggaggaaaggaatgtccttaggttggaaaagtcaaggaaacagattctcccataaagccttaggaagggaacacagccctgtgacaacttggttttagcccagcatcaccagtcagaactgtaagataataagtacatgtgtgttaaggcactcactttgtgaaaaagtgttacagcagcaaataagaaactaatacaggaagtaactactgagttattgttcctaacccttctggaccaaaggagaataaaaactattttttaaagtatatggatttcttaagcaaaaaaaaaaaaaaaaaaaaaaaaaaagttagatgaaaggttcatttttcaacactgtagcttaggtataaacataatatactgaaggactctgtttagtcaagttgatttgttttcaggtgtaatacctacaacagttaacatctactgagcttttaatatgtttgcaatataagtgttatcttattaagtcctcacaacctttgagccagacactattagtactgggccatctgtgaaaagtcatttcacagatcagaagcctaaatgtaagagctaaattattaaactcttaaaaaaaaaaaaagagaaaaatcaatttcatgaccttgagttaagcaatggtttcttagatataatcccaaagcacctttaaaaacaaaacaacaacaacaaaaaaaagaagaaaaaagagaagttggatgacatcaaaatgaaaaactttggtgttgcaaacaacaccatcaagaaagtgaaaaggcaacctactgggggaaatatttacaaatcacatatctaataagtgtccagtgtgcagaatgtattaaaaaaaaacaactcttacaattcaacaacaaaaagaaagaataggacaaatattttaacagatatttctttaaagaaggcatacaagggaccaataagctcagaagcacatgctcagcatcattacacaatagtgaaatgtaaatcaaaaccacaagacaccgcttcacacccactaggatggctacaatcaaaaaggcaaaataaggcaaggcacaggggctcacgcctgtaatccgaacactttgagagggcaggtgggaggattgtttgaggccaggagatcaagacaagcctggacaacataatgagactctgtctccagaaagaaaaaaaaaaaatttgtcttgagacagggtctcactctgtcaccacccaggctggagtgcagtggcacgatcagagctcactgcagcctcaatctccttggctcaagcaatcctcccacctcagcctccccgagtggctgggacttcaggcgtgcatcaccatgcccagctaattttttttgtattttcagtagtgatggggttttgccacgttgcccaggctggcctcaaactccacggctcaagcaatctgcccacctcagcctctcaaagtgctgagattacaggtgtgagccaccacacccagcctgtaccaaaaaaaaaaaaaaaaattaattttaaaaaaagtgcaggccaggtgtggtggcccttgcctgtaatcccagcactttgggaggccgaggcagatggaccacctgaggtcaggagttcgagaccagcctgaccaacacagtgaaaccccatctctactaaaaatacaaaaattagctgagcatcgtggcaggcacctgtaatcccagctactcaggaggctgaggcaggagaatcccttgaacctgggaggtggaggttgcagtgacctgagattgtgccattgcactccagcctgggcaacagagtgagactccatctcaaaaaaaaaaggtgcaataacaaggagtaatgagcacacagagaaattggaaccctcatcattgctggtaggaatgcaaaatagtacagccactttggaaaacagtctgggagttcttcaaaaagctaaacatggagttaccacattcctaggagcaatcccactctaggtatgcatacaagagaaatgaaaacatatgtccacacagaaactagtacgtggatattcatagcagtattactcataagaggtcaaaaagtggaaacaacccagatgcctatcaactgatgactggataaaaaacatgtggtagggccaggagcgttggctcacgcctgtaatcccagcactttgggaggccgaggcaggcgaatcacgaggtcaggagatgaagatcacggtgaaaccctgtctctactaaaaatacaaaaaattagctgggcgcggtgacgggcgcctgtagtcccagctactcgggaggctgaggcaggagaatggcgtgaaccaagaaggcggagcttgcagtgagccgagatcgcgccactgcactccagcctgggcgacagagcgagactccgtctcaacaacaacaacaacaacaacaaaaagaaaagaaaaaaaaaaatgtggtatagtcaaaccacggaataatatttgggaagaagaaatgaagcactgatgcatgctacaacatggatgaatcctgaaacaagataaggtggagtagcacatcacaaaagaccacatactttacaatgccctttagatgaaatgtccagaataggcaaatctgtaagagatttgtggctacctagggcttgagagggtggcggtggagggcagagaaggaaatgactactaatggatataggattccttttggagagggcagaaatgttctaaaattagattatactgatagtcgcacacgctgtgtatctattaaaaatactaaattgtacatgttacatgaataaattgtatgacatattagttatatctcaataccgctatttaaaatgtgatttaacttctgtatcccatatgtattcatgagttacttactaagtaatttttatttaaggaagtaggtgttttaagaagtatttgtaggagaagcatatataaccacaagagggcgctttcctcacagctacagaaaaccgagtgtctaacatacaggggtcctatttaccaatttgatttcattcttcccccttttcttggacggaatgaggtattagtatgtttcatacaacacattaaagacaatagtgtcaccaaggttggtgacaggttgaaaaatcatgacttatacacagataaaaagtaaatgtttaaaattaaacttcagtaacagaaactacggataatgttgcactgcattcatttccttcacttcttgtcatacaagaggttatacaaacttatttgtttaggataaaattcagtgagataatataaatcatcacaggaaatgaaacatgttataaatacgtggtctctggttctctgttctatctctagcacctggaaccatgtctagcataattggcactccataaatatttattaaatgaatgagataaatgaatgaatgagtgaaatcaacatttcttaaatttcagaaaaaatttcacctaccttggagactacatcaaaatatttcttttcacccataccaaacatcacaatcatttcactgaataactatctctgaaacaagttcacagagacattgtgtgaaatcaagtgtaattttttaggccatgaatccttcccgacctcccccttattcctgctgtcatcttaactttttttttttttttcttgaaacggagtctcgctctgtcactcaggctggagtgcagtggtgcaatcagggctcactgcaacctctgctcactgctgcaacctctgcctcctggattcaagtgattctcctgcctcagcctcccgagtagctgggattatagacgcctaccatcacacccggctaatttttatatttttagtagagatgggatttcgccttgttggccaggctggtctcgaacttctaacctcaggtgatctggccaccttttcctcccaaagtgctgggattaccacgcccagccaatcataactttttttttttttttttttgccttgaaatcaacaactctgaattacttccagtttgcattctgtgtattgagacccacaccaaactgaagtgtcacccaggctggcatgcaatgacatgatcacagctcactgcagcctcaacctcctagtctcaagtgatcctcccacctcggcttcccaagcagctgggtctacaggcatgcgccaccacacccagctaacttactgtattttttgtagagacagggtttccccatgttgcctggtcttgaactcctgggcttaagcaatcctaccacctcagcctccaagagtgctgggattactagcatgagacaccacgcctggcccaagaatttttttttttttttttttcttaaacagagtcttgctttgtcacccaggctggagtgcagtggcacgatctccgctcactgcaagctctgcctcccgggttcacgccattctcctgcctcagcctccctagtagctgggactacaggcgcccgccaccacgcctggctaattttgtttttgtatttttagtagagacgggatttcaccgtgttagccaggatgttctcgatttcctgacctcgtgatccgcccgcctcggcctcccaaagtactgggattacaggtgtgagccaccgcgcaagaccccaagaatcttttaatgctgaccaacacatctctctcattgtgttaccttttgtattcctacttaatgtttttccatcaatgcacctcttactaagccacaagcacacaacatttcattagaggaaaccagattcttctcctatctcatgtttcaaggggtctgacatcagactaatttatggaacaacaataaaactgcccctatttcctccccagaagccacattcagttacaaaaacttttactctaagctcagtcacaacaaaagttaggcatggaaaggcaatctctgaaaggtttttcatttgggatgtgatgaatgggtgaaggatgagcttttacagacacagggcccggtcatctttaagacacctcgagtttataagccactggagcattttcatagcaacatagtataaaagaaaccggatcaccaaatgataaactcaacttgaaaagtcttcctctgccgtttttttagtgaacagtctactgtcaaaacaaagatgttatgtttagtcggttctaggcagcccagaaactttaaatagaatgccaaaacacattgtgtttgagtgacaagggaactaactctcacacatcattcactcatattcctcaaaattactccgtgtaactgagggctatactagatgctggaaatataacagcaagcagggcacattccctgccctctgggactgcaccgcctggtaggccagatggacaaataaatgagcaataataaaacagagtagactgtcagggacaagttcatggtgttatgggaacacaggggttgaacatctaattagccttgggtggttaaaaataactataaatggatatgataacaccgctgaatgttaggagccgttaaaatatggggagaaaggcatatttctcagaaaataatagcctgtgccaaggactgaagacatgatagctcagcaagttcaagaagtaagagagagctcaggatggttgaaaccaagcatggaaagtgacggggttaagaaagtaagcatgagccaatcaagaaaaaagtttatttagtcttgatccttagggagtcatccctgcaatggcctgcaaagttacaggttgcatttttcctcttcccccacttttactagacctttctaggtttccttgaggtcaaaccagaagtctcagaagtaattaacataaattgaaactcaactgtgcccaagtaaactcacataaaacaatgatgaaaaaatctccaaaagcccatgagggcaggactagcaagtcacacatatgttacaagtgcttgaaggtttttcgaatgtttttcaaatgcagtttgtcctgggaatcacacaatgatcccacacgctttctcatcccaatcttacaaataataatttttatttaaaggagaatggactagccaaggtcttgaactcaggaacagaactctggtctaattccaaacatcatttacttgccaccataacagctgcttccttctggaagccagtggctagtatgtacctacattatgaccactttcccctatgcattttagattattcatttcaagctattctagggaactgctcttgcagttctatgcccaagttcaatcctaacacaccccatcaccagctgcgttgcagaggtctgctcacagttcaaagtttggcttgcactcaagaccctctgtggcaataaaatcatctctacggtagctcactctaaattacttccagtttgcattctgtttattgtgacccacaccaaactgaagtgtctcagaaagcattaaataaatcagtgttcagagaaatgaggcagcctcaaaggaaaataatattagctcaatactagccataaatcaaccattatgtgtgggagttgctcagtgaaaacacaaggaaaatttagagaagtttatttattcccaaagccccaagctcacacaacaaacaaaaaattaaaaataaataatgaggccaggtatggtgacttttgcctataatcccagtgttttgggaggccaatccaggagaatccgttgcggccaggagttcaagaccagcctgagcaacatagtgagaccccatctctacaaaaaaaatgtaaaacattagccaggcttggcgacacccacccgtagtcccagttactgaggaggctaaggcgggaggattgctggggcctaggaggtggaggctatagtgagctatgatcgcaccactgcactccagcctgggtgggagtaaaactctatctctaaaaaaataacaaacaaatgataataaataaataatgaccaaaatgtccagtcagtggggaagaaaggaaagcaagtacataaagtagtaagatagtgccaccagtcctgtggtattcttcccacccccaccactcccaaaggatgcttaacgttccccagtcaagagctcctctaggctgtaataaaagcccttgaaaatcataccggggtggccaagagaatggcatagaccctgaaatctccccactacattctacagttccaggacaaggaacattttgcttggctataaggcccctcagttccaaacattactgagtatcatttaatcctttagccaattcccattttacacttgaggcagatgatcaccagagaagttaggtaagttaaagttaattggccagtctaaggaaaattcagaaataaaatccaagtctctgagcccaaacttactgagccactttaagtattaaaggacagaaccgaagcacgtaaagtggctgatttagccgggatctccctcgcccacggccctatggctgcaattagggacctaaaactgatgagcactaggtggggtttatggaggactccctagaaaaaaacaaaacaaaaacagaaacaaaaaaagtttccttttcaaaagtccttgagcaatatgcaatctcaataatttggacaaattttcctgtctttgttctgttttccacaaaaaggaagcattctgcacacaaacaaaaatctcatagtccatgagataaagctcttgcccagagtgctcaggatcagaaacattataagcagaatcagtaatgattattaacgtattaaatgtattgcatgtcttttacttcaaaacttacagacctaactaaagatgtctaacagaaagattttctttttaaaaagccaacaactacttgggaagaaaactagttgtatatgtgcttaacaggctaggcaagtttacgcttaccccgatttcacgaaataaacccaacgtttaaaagccaagatgcaatacttaaaattaaaaagaactataagaccactggcccatagtgagaaaaaaggaaaataaaagataaaacgatttgtttgaccttctgatcctattgccttcttaattacaacagttcacataattgggaaggaaagaacaaaaaagacatggaagtccactgaggcctccttgcaaaatagttgtccagcaaagctctgcctaaataaatcttttattaacctagactccacaagtttttaatccaacccctttgaagtccagtaatggtccttctccttttactaaaagccaaattagatggccattttaagggttaatgctcttgaatggttaggcagaagacaaaaagacggcctatttttcctacaacacagagttagatcttgataaggtagcattttataagtcctctggagtcagctgtagaggaaaaaagtgtcaagctcaagctaataaagtgggaaaggggtagcccagacccaaagcatcatgacatttcagctaacaacctcagcctcgcgggggaacatgcttgtgcttttcggttctatagttgtacaaggctggtacaacgaagattgtgcaggctggcacggtgactcatgcctgtaatcccagcactttgggaggccaaggcaggcagatcacttgaggtcaggagttcaagaccagcctggccaacatggtaaaatcccatttctactaaaaatacaaaaattacctgggtgtggtggcatgcgcctgtaatcccagctactggagaggttgagacaggagaatcacttgagcccaggaagcggaggttgcagtaagccaaggtcgcatcactgcactccagcctgggcaacaaagcaagactcctcaaaaaaaaaccttaaaataaaaataaagaatgtgcaaatcaacatgctttatacgtgcaattcttttaaaacagacaccccacacagcgcgtgctgtccatgcctccattactgccaacctctcttcgctccaagccaatgactggtgcagacccagcctgcgtgggaagaacacacactctcctccttcgaagctgaaaaacccaagaggggcgcatcagacaatgaagacacaaattctaggtacagtcagcccttcgtatccatgagttccacatctatgaattcaatcaaccttggttaagaatattcttaagcctacagcctgctgataccacgatagacattcaaaagcacactgctgaaaaaatactaatattagaaaatatttaagggacattacatggaagaaggctacaaatgagaatatttattatactggagggtatacagttacatattttaaacacagaaaagagaaagggagggaggagacaaagaaaatgaataaaagaatgggagagaaggcaggaagaggtggaggatggtcacagaaatgaaatcaataccatatgctatcctccatcccaaattaaattaatgaggaggtaaacgttcttattggtagcttatgggtagtgtttactctgttttgtgtgtgtgtgtgtttttccatttgccaaattttctacgttgaatatatattacttccatagcagaaaaacattcaaatatatagataaatgttctgggtgtttctttaaggctttttcaaaaggacagtctgagctgggaccacaggcaatgcaattgccttcaggtgccttttcaaaacacagatcttagccccatccaaatccttttacactagttctcccttatctgcccagaaaacattccaagaaccccagtgaatgcctgaaaccatgaataatacccaagtctacgtattttttttctatacatacatacatacatacttctgataaaaaaatcaatttataaattaggcacaacaagagattaataacaatagctaatcataatatagctattaataaaatagctattaatagaaaactaataaaatagccattaataattaatagcaagccagaagcagtggctcatgcctatcatcccagcactttgggaagctgaggcgagaggatcatttgaggtcaggagttcaaaaccagcctggccaacatggtgaaaccccgtctctactaaaaatacaaaaattagccgggtgtggtggtacacacctgtaatcccagctactcgggaggctgaggcaggagaattgcttgaaccaaggaggaggaggttgcagtgagcgaagatcatgcactccaccctgggtgacagagtaagactctctcaaacgatgataataatagtagttactaataactattttaaactaatacagttttttattaaaactaatagaatagctaataatatattgttatagctagctatatagctagctataacaatataataaaagtaaaataaggattccttgaacataagcactaggatactgtcccacctgatctgatcagctactaagtggctaacagggaagtggcgtatacagcatgggtccgatggacaatgggaggattcacgttccagggagaatctagtaaaatgactcaaggttcattacactactcagaaccacatgcagtttaaaacttatgaattgtttatttctgaaaatttccattggatattttcagaccacagttgaccgtgtataactgacaccacggaaagcaaaaccatggattggcgcgggggagggcaggcgctactataaatcacaacctccaaggtaagagcctggtttttgcattttaagtctctctcagggagtctcatgcacaccaaagtaggagaaatagggcatttgagtttggaaaactggttactcataaggctgaattctgaccctagagataagtctcatccaccagctaagttgaatgtatttcttttattgctaagaaactttttgagaactgtctctgaagaagtcatgcttgggaagacagggatgttggaaggcacaaggaatcaaggtggaaattgctggcagggcttcatcacattatcaggtgtgcaccatgctggcgctctcagggcttagccagtttagccaggatagatggaatacagaatgaatctatctgtgacaacttttcataagattattcaggccctggcaaaagatctacatgttggtcaactgtaaacaatgatagctagtgagatgaactctcattcacagagtctggggcaattaaaccaattactttccactgtgaatcccaggatctcagaaatgccaaaggagaacaggaacttagaaattatccaaacccttaccttttactgagaagaaaagcaatataactgaggcatggagctgggagctttaatcttcaaagtatttataagcagttgagagatactctggataaattaaagaattagaataaccattgagctcacttcaagggttgagcctaagaatctgagttgagatactgatgaaagcagctgcgaaaatgcctgcaactgctggcctgggtggagcagctgcaggtctgcatctgtctgggaggactgcatttccaggacagtctgtccactagtctctcctttcagtttaccttctcccaactctgaaggagaatccagttaaggaatagatcaagaaaatatattgcacagctatatctctgcaccaacatcatatagacaaaaacaactcaattttctgctatttgatgctggttctttgtagatacagatgctgcgtaaagtttctgttgtctaagaagttatacaacattctcaattgatgactaaccactgtaaacctgctgtctttatgtcaaacccactgccttcctttttcctcggagcaagacagccaccatatctgtgatttattgcgctaccacaatacagaacacgactcgacctggaccacaccctaaggctagaagacagcagtaacactaaaaggatgagacgcaagccattgccagaagatctggaatggccattttccttctcgtaaaaggaaaaactcaaaaattggacctaatcaaaactaaaacttgtgctctgtggaaagaggctaaaaatacaagccacaggcagggaggaaacatttgcaagccacagactcaacaaaagactgagacctagaatacataaggaactctcaaaactcaacagcaccttttcctcagttgctgctaaggcatttggtccttctgaggaagctcaggacctgttggggtatggccttctctttatccagtgactaagactgcgcccagcagccacttccccagcccccacccataacgcagcctcaatctctgagctcacctgcatccactcattctgcaggacagtgaggtgatagtcacagaatgaaaatcaaaaccctcattaaagcagctggtgtcaatggtgaacctttctggcctagccaatgtcagcctcaggagccccctctgctgtgtagagcctaggggacctgcctcacaaccagcgatgccccagcaggagaccctatccctccaccctgctgtcctcactcagaaaaaaagagggggcaaagaaaagagaatctgaggagccccacgatgacatgggccttggtctttttgactaaatcttttatgtaatatgttcaataaaaagctgaacaaaacacaacaaaacaaaccctcatcaggaaaaaaaaaaaaaaaacccacaaactatccgggtataagatgggcaaaatatataaacagacatttcaccacaaaggatatacagacagcaaataagcacatgaaaagatgtgtgcaacatcactatccaacgacgcaaatgactaatgctaatgagataccaccacgtacctatcaaaacaggtaaaatcaaaaacagtgacgacagcaaacactagtgaggtcacggaaaacagtttgacactttcttataaaactaaacaggtgactatcatgtgaccagcaattgctctcttgtgcttttaaatgagaaaaggacatttatgttcaaacacacaaaaacatttgcatatttcatacactatgaacatgtgcatatgaaatacacaaatgttcatagcaactttatcagtaatagccaaaactaccatcaacacagatcttcttcaatagctgagtggctaaaaaaaaagtatggctcatccataccatgtaacactactcagcaatttttaaaaatgaactgctgatacacacagtaacctggatgacgccctcaggtggctacgctgcatgaaaaccataatcctgggctacatactgtgtcattccatttgtataacattcttgaaatgataaaattgtagagatggggaacatattagtgactgagaggggttttgtaaaatattaccattggaagaaattatgcaaaggatacactggatggccctgtagtatttcttacaactacttgtaaatctccaattatctcagaataagaagtttaacttaaaatgaagcctgctctatttcggtctccaaagaaacagaaccataagatgataagatacacacacacacacacacacacacacacacggagagagagagagagatagagatttaagaaattggtcaggccgaggggtgtgatggctcatgtctgtaatcccagcactttgggaagcctaggcaggtggatcacctgaggtcaggagttcaagaccaggctggccaaaatggtgaaaccccgtctctactaaaaacacaaaaattagtcaggtgtggtagtgcacacctgtaatcccagctacttaggaggctgaggcgcaagaattgcttgaccacaggaggcggaaggtgcagtgagcagagatcgtgccactgcactccagcctgggtgacagactgagactctgtctcaaaaaaaaaaaaaaaaaaaagaaaagaaaagaaaagaaattggcttcacaggactgcggaggatggcgagtccaaaattgcagagctggcacaggccggggtcccagggaagaactgatgcaaagacactctccaggcagaattccttcttcctcccaggagctctattttctttgtcttttaaggctattttcttttaagtctattttcttttaaggctttcaactgatttgattgatgaggccaatccccattggaaagggtaatctgctttgctctgaatctattaataccaatgtaaacgttattcttatctaaagaataccttcccagcgacatccagactggtgtttcaccaaatacctgggtaccgtggcctagccaagtacaaacaaaattaaccattacagctgctgtttcatctcttttctgctgggcttttggtcactaagcagaaaatatgaggggaaacggacacactggctcccacagcggttggtctctgacatcagctatatctatgtggggcaagttagctattaataagttttgccatgaaataaaattaaaagtatttatattcatttactttaaatctttttaaatgcctaaaccttctgaataataatatgctattcctaatgctctaaccaaggggtcggcatatttcaactataataaggtgccgatagtaaatactgttggcattgcagaccatatgctctctaccctaacctctcaattctgttgctgtcatgggaaagcggccttgtactatacatgacaaatgggaatggctgtgaccactaaactttatttacagaaacaggctgtgggtcagatttggcctcagggccatagtttgaggatgcctcctctgttaccaacaaaatttcaggtacttttcattctttctctcatcttccaagggtgtgatcttggattgaaactaatcatctgtattttttttttccaacagcatttacttttcatccagaaaaccttagctatgccgcatgagttctgattatctattaaacatgaagctcaagtggttatttgctagtcacttttaagtgtttggaaaaaaatattaaagtcctcagtctctgagatacaaggcaagtccaattagtgcagacaatgtaagccattatccagctgcaatggtctcttacattttcaaaagaaagagtggaggcaggtaaacactagcccagtaaacattaaggatgcatctaaggaagctttaataggggcaggatacctgtaaagagtctatgactcactacattattctagaatagatttttaattactctgatctatgtatggcaactgctgcttctgattaaatagatttaaaatgagaagaaagaaaacagaaaccggccaggcacactggctcatacttgtaatcccagtactttgagcagtcgagccatgcagacggcttgagccccagagttcgagaccagcctgggcaacatggcaaaaccccatctctacaagaaaattagcctggtgtggtggcaaaggcctgtaatcccagctacctgggagactgaggtcaggtgatcacctgagccttggagttcgaagctgcagtaggccatgatcacaccactgcactccagcttgagcaacacagtgagacccagtctcaaaaaaaagaaaacagaaatctagtttctataaatactaatattttaaccaatattaatatttaagaactttgaagaatccagagcacggacaggaaaaataacacagatttctagtggagattattcaatgtatgttgggaagttttgtcatctaaggatacactcaaatctaagcgtaaccttggattggactgtgctgtactgtttatgggcattacagctatggagcaacagcccttgaaaggaatatagtttgtctcatttctaaaatgcatcttcaattcttcaccttaaaaacatagccttggcctggtgcagtggctcacacctgtcatcccagcactttgggaggccaaggcaggcagatcacgaggtcaagagatggagaccatcctggccaacatggtgaaaccctgtctctactaaaaatacaaaaattagctgggcatggtggggtgtgcctgtaatcccagctacttgggaggcttagaaaagagaatcacttgaacccgggagacggagcttgccgtgagccgagatcacaccactgcactccagcctgggcaacaaagcgagactccatctcaaaacaaacaaacaaacaaacaaacaaacaaacacagcctcagaagcactgaaaatgacaacccctcgcccattccatgcctttcttcctcccgggaaacataagtcatcaggacccatggagcagacatcattctgaaaggcacatcaaagacactctgaagttccaaaggaagccgccaactgtaggcctcgggccaagataggtgtaggggtgctgccctttaccatggctcttgcctctttaccatggcttaggaaggatgctctgggtttccttaaacttcgcagattcatgctgattgcagtcaaaataaatattcccaggagctttgtgaactgaaatttcctttcatgaaaagaatttctagaaatactacagctacagtagtccccccattatccacggcttcgctttctgcagtttcagttacctacggtcaaccacagtccaaaaatattaaatgaaaaatttcagaaataaacaattcataagttttaaatcatgcaccgtcctgagtgatgtgatgaaatctctcaccattccactgtgtccagctcaaaggggaaccggcctttaggacagcatttctaccccgtataccctcaccacccattaatcacatatcggccacctcagtgagcaggtcgactgtcaaagtatcacagtgcttgtgttcaagaaacctttattttacctaatgatgacccgagagtgcaagactagtgaggctagcaagtcaaacagccaaaagggaagctgtaatgtgcttctgttagtgaaaaaggtgaaaattctcgatttaataagcaaagaaaaaaatcatatgctgaggttgctgagctctatagtattctatctgtgaaactgtaatgaaggaaaaagaaattcgtgctacttttctgttgcacttcaaactacaaaagttatggccacagtgcattacaagtacttagttcaaaaggaaagaaaaatgtttgggtggaagacatcaacagaaatgggttccaactgactgaaacatgtggcaccaggaagcaccgagcctatacaaagacttcagcaagggatcccctaaaatgagtgacactaagttatttgttgcaagtagcgaatggttgtgcagattcaagataagcttgtaccgaaaaatacaaaaattactggagagtctctatctgctgatgaagaagcagctgtcacatttccagcagagttgaagaagctgttgatctcattactgtgcctagtttataaattaaattttatcatacatatgtatgtatggggaagagcaaagtatactatagaatttggtactattccatggtttgaggcatccactgggggtcttggaagatatctcctgcagataaaggaggactacacataataaaagagcagctgacatgtcagttaattgtagttttaaatgaatatgcaaacaaaactcatatttatgtgttttttaaaaaatatttatttgggctgatgtttccacaacttttgaaaactctgtagtgtattgcacattttcccctcacattaataattgtacccaacgctttacatttaaatattcttcagctgagaagatgtctggaagttgaaaaaaatagataaaacaagcaagcatattatttaaacacaaataatgtaccattttaaaataagttaatactacgtttcccaattattcagacttcctgaaggttccgactgcctaattccaagtctaccacttactttgctgaatggcgttgggcatgttactttcctcccaagtttcagtttcctcatccataaatggagagcctaataatacctgctccatatggggttctagtggcgaacaggtgacttaacacatgtaaagcattcagaataatgcctggcacgtggcaagcctttagtaagtgctaatcctgatcatcagcttctttttcttcttcatcattaatttgtggttcttacatttaaaggtgtcagggtagttcaatgtaggagcaagcaaagttttaggggtggcatgttaaatattaaatataatcaatccttccctccccttggagtattttctatacactgaagagtatcttttagtaattgtgaatttcttttttatccccacaaagagttagagggaaaccttagcaaaaccagacattgtgtatcagtgagtccaattgtccagtctcatagtctttataacccagcaaacaggcccagtgaacaggtgcttggaagggcagaacatggactgcttcaaacaatcagaaatgcatccaataagatatgaactcccaccatgggaaatacgttttttaattagattaaaaaaaaaactgatgtaagaaattggcaaaattgttgcttctgaaaaggagtgatagcaaaaactaaaactaaaaataaaataaaatttttaaatatgtatccattcctatggtttccaagtattttgatgttagcttctaccaggactgcctgatatttttctcatatattttcttcctttatcttagagtgaatctatttgtcacacagtttattgttcctgttaggttggtgcaaaattaattgtggttttcgccattaaaagtaatagtaaaaaccgcagtcacttctgcaccaatgtaatatttcccctgggataaaacagagttggatgaatcaggtgctcacaggcaaatctccctggaagttcctacttagttcttctcctctgtcactttatatttatttgcaaattgtcaagcaccattggtttatatttgagacacttatgaaaatgagagataaagaataatttcaggtaaaactcttcttgggcaacacagatctaatgtttccaatgaaataatcacttcctgaaatggaaaaataaaataggaagtcaagaaaaaatacagatttcaagaacagcatgggtttagcttcaagttaaacagaaacactgatgcagacaataccaatcatttgagtcttttgagatctaatacagagcatccaaaggaaaggtctgatgagggaaagaaaatccaaagctttgaaatggtcaaagtagctaggtcttgaagtcagatgcaaagttataacattctagaaaaatgtccggtcgcttaagtcttagattccatcaaagtgatgaccaaatttagagatgaataaccgtacttggatcacttagcagaaacagcattataggccaacttggctggaaaaaagctctccattatcaagatctgaggaagacctctgcaaatccaggtctccatctccctgacagcctccttcactttctaacagctcctcgaccaatcacttctcctacattctaacccaatggctctcaactctttaaaaaatgcagataggttttaaagtttagtggaacctaacatgacagtaattatattttaaatatctgttgggtaagaaaatgcatagaaacaaaaacttttcaattcactataagattttctactttattaacccctaaagcaggggtccccaaaccccgggccacagactgctaccagtccatggcctgctaggaacccagccacacagcaggatgggggcagtaaactagcattacctcctgagctgggcctcctgtgatatcagcagaggcattcaattcccagaggaccatgaaacctattttgaactgcacatgttggggatctaggttggacactccttattagaatctaactaatgcttgatggtctgaggtggaacagtttcatcctgaaaccatgctccctgccccactcaacctcctggaaaatttgacttccatgaaaccggtccctggtgccaaaaaggttggggaccactgccctaaaacatcttcattcagttaaaatttttctgagagcctactatgtgcaacgcattattcttagcatttgaggtacaattctgcccttaaaattctcctccttccctccctcctttccatatcctatcagaaaaggtctgaacaaaatggttattctgataggagaattctaaattctatttgatgggagggatgggggagacaaggaagatggaggcaactctccattcctccttggggttgtaatttttcaccatgtgaacgcattcatgagttactcgtgtaattaaaaataaaagatggtaaacagagcatctgtgtaagaaatgtctagaaaaataaaaagtcctttagaattacttcaaggccctctaaaaatgtgcccaaatccacattgcaccctggggttcagaaagcagtggctcttgcaaattgttcatatcaattcagttcaattatctggtagcaacactcaggcaagtaccatctttcttttgttcattcctgtaacatctatcaagtacacaatacctggcataaaacaaacactgaattaggtaaatattaaatggctgactgaatggatgactgaagaatgcctagtttcctgcctcaagtaccgaatgcctaaccattttccttccatggtgacttcaacacactctccaaaactccactcaaaagatcatctcatctgtgtgtgtgtgtgtgtgtgtgtgtgtgtgtgtgtgtgtgtgtcttttgttggcatctaactcatctatggtgaaaaacacaaatttcatctctataacctcaacattttctactgataaagacatccatgtaaccaacatgcagatgaagagagagagaggacattaccagtactcccaccacactgcttcaatatggccttattttaataacatccttgcccatttttttgtttctttgttttctgctacttgcaaaatcaaagtatttcactttgaataagataacagctaaatgagctgattttttttaactagagttagcaaacatctctaatccagtaaagtgatgtcaattaaaaatagtattaggaatcctgcgatattataacagcaggtgacaatttaacactgtttggactaaaatattgtaggtgaaatttactgtaatagagattgtacatatgaaaaaatatcaaaggtttctaattttaatacattttccctcaatgctcaatgcttaaataattttcctttacatgcttactgactataaataaaagatagacttaaaatttcctaaaaggaaattttagatgtgatattacatgacctctctacattctcatctttaaattattccctgtgaaatcttgttcaatccatcatttgagcatgtcagcaggaaaaataatttcttttttgttttaattttaggttcaggggtacatatgcaggtttgttatataggtaaactcgtgtcatgggagtttgttgaacagattatttcatcactcaggtactaagcctagtatccaacagctatttttccagattctctctctcctgtcaccctctaccttccagtaggccccagtgtctgttgttcccctctctgtgtccacgtgttctcatcatttagctcccacttacaagtgagaacatgcagtattggtgctggaggccattatgcttagcaaactcatacaagaagagaaaaccaagtactgaaaaataatttcttaaatgaattttgcatatgacaaaagatctcacacctcctctaactcagaaacaataacacgagtgcttcaacaaaaattgtaaccaagattcaggaagactccttaaacctttaagacaatcatgatagattaacaagaacctagcacaaactgaggcatccctaaattccactctgcatctttccaagagaaaactctaagaacattcaagtcccctttataacactgaagaaattcgaaaaacaaacattcatcttactgatgtagaagaacagaaaagcatcacactattagctcctccaatggcctggcagagaccctgcgtggcacaagccacaaataagaacattctaaagaattaaccattttgcaaaacagaacatttctcagatggcttagtaaaaaaaaaaaaaaacacacacagtgacatcagaacattaagagaggggagagattttcagataacatcactgactggtataagcaatgtatttatatcaataaattgatataaatttattggtataaactgatatatataaatattgatatgaattgatataaattacattgatatttatatcaatatgttatactgatataaattatattgatattatattaatacatgttatatactgatataaattgatatttacgttattaaatcaagtttagcctaaagctgcctctttacatattttaaatttggtctaaaggtttttctgtacacatcatgaactatagcaagtggcaatgtaaacggaccgtagcctacacttgtgccaatcaccaagtttttcccaatcaaatgtacccaactgtacagtaatcaaaacggcatggcactggtaccaaaacaggcacaaagaccaatggaacagaatagagatctcagaaataaggccacacatctacaaccatctgatctttgacaaaccggacaaaaacaatcaatggagaatggattccctatttaataaatggtgctggtagaactggctagccatatgcagaaaattgaaactggaacccttccttacaccttatacaaaaattaactcaagatggattcaagacttaaatgtaaaacccaaaactataaaaaccctagaagaaaatctaggcaatatgattcaggatataggcatgggaaaagatttcatgacaaaaacatcaaaaacaattgtgaacaaaaccaaaaattgacaaatgggacctaactaaactaaagagttaatgtacaacaaaagaaactatcatcagagcaaacagacaacctgtggaatgggagaaaatttttgaaatctatctatctgacaaaggtctaatatccagaatctataaggaacttaaacaaatttacaagaaaaaacaaacaaccccattaaaaagtgggcaaaagacaagaacagacacttctcaaaagaagtcatttatgcagccaacaaacgtatgaaaaaaagctcaacatcactgatcattagagaaatgcaaatcaaaaccacaatgaaataccatcttatgccagtcagaatggcaattattaaaaagtcaagaaacaagagacgctggcgaggctgtggagaaacaggaatgcttttacagtgttggtgggaacacaaattagttcaaccattgtggaagacagtgtggcgattcctcaaggatctagaaccagaaataccatttgacccggcaatcccattactgggtatatacccagaggaatataaatcattctattacaaaggtacatgcacgtgtatgttcactgaagcacattcacaatagcaaagacatggaatcaacctaaatgcccatcagcaataggctggataaagaaaatgtggcacatatacaccgtggaatactatgcagccataaaaaggaacaagatcatgtcctttggagggacatagatggagctggaagccatcatcctcagcaaagtaacacaggaacagaaaactaaacaccgcatgttctcactcataattgggagctgaacaatgagaacacatggacacagggaggggaataacacacactggggcctgtcaggtgggggacaggggaaaggagagcatcaggataaatagctaatagatgcagggcttaatacctatgtgataggttcataagtgcagcaaaccaccatagcaaatgtttacctaggtaacaaatctgcacatcctacacatgtatcctggaacttaaaataaaatataaagaaattttttaaaaattaaaaatttttttcaaaaatatagctggccaggcacggtggctcatgcctgtaatcccagcactttgggaggctgaggcaggtggatcacaaggtcgggagatcaagaccatcctggccaacatgatgaaaccccatctctaccaaaaatacaaaaattagccgggcatggtagtgtgcgcctgtggtcccagctactcgggaggctgaggcaagagaatcctttgaacatgggaggcagaggttgcagtgagctgagatcatgccacttcactccagactggcaacagagggaaactccatttcaaaaaaaaaaaatgtagccaactgtttgaactgtgttttaatagggcaaacgccgagctgtaaccaattcaactgttactgtacctcacttccgttttctgtacgtcactttccattttttgcccgtaagtctcccaccacataactgcgttggaatctcggaaacttctctggctcagatggctgtccagttccccaatcattcattgctcagttaaactcctttaaatttaattctgctggagtttttatcaatatcaatttactgatacaaatgaattgtgcacaccaatcagtgatgtcatctgaaaattagtttatatcaaactgatctaaatataccatgcctggaccctgtccactagatgccagtagcacaccccatagtttgtgactataaaaactgttccagacattccaaatgtcccccttgaagaggggagggaggagacagtgcaataaccatccatcatttgagaactactgatttatactgatgacatagttgatgatgataacgatggaaacatcatcatagcaataaaataataaaaacaatttcctcctattcagtactctactcagatgctatgccaagtactttatatacactttcttctgtaagaccaccctatgagacaggtattctaattttccacattttatagtaaagaaactgaggctcaggaaagttaaatgccctatttaaggtcacacagtaagatgctgtcctaatctgttcctgttgctataacagaacgccttagactgggtaatttgtaaataacagaaattcacttctcccagttctggaggctgggaagatcaagatcaacattccagcagatgtggtgtctggcaaggacttcatctctgctttcaaaacagagctttcttactgtacattgacatataggaaggacaaaaagggaccggctttctcttcaacctctgtttataaggacactaattccactcatgagagctccaccctcgtgacttaatcacagcctaaaggccacacctcttaacactatcacattggcaattaagtttcaacacgattccggggcaggagagggacactttcacaccatagcagagggtgaccaggggttcgcaaacaagcctaacttacaagttcataattttaactaacatgctatatattgccatctccaccacacagagaattatgagagtgctctgggaacccagcaaccggctattccaaacagaagtaaatggagaacacagtacccaaaagatacaacagataatgtctggtagtgagtgaagtaggccgccaccagactgcaaatgctcatcttccctattaataacatgtgctttaaacacaacgtgataatcctcagagcaacctctcaagatagataccagtatctccatgttacggatgagaaaactgagtacagagcgattgagtaaattatccaagatcacagggctgttttttctgatggagccaagatttaaaatgagacccagccaggtgtggtggctcacgcctgtaatccagcactttgagaggctaagttcggcggatcacttgaggtcaggacttttttttttttttggctcttgttgcccaggctggagtgatcttggctcactgcaacctctgcctcccagattcaagcaattctccagcctccgcctcccgagtagctgggattacaggcattcgccaccacgcccagctaattttgtatttttagtagagacacggtttctccttgttggtcaggctggtctcaaactcccaacctcaggtgatccacccgccttggcctcccaaattgctgggattacaggcatgagacatggcgcccagctgaggtcaggacttcttgaccacccttgtcaacatggtgaaaccctgtctctattaaaaaatacaaaaaggcaggcatggtggcacactcctgtaatcccagctactcaggaggctgaggcaggagaatagcttgaagctgggaggcagaggttacagtcacccaaatcgtgccactgcaatccagcctggatgacagagcaagactctgtctcaaaaaaacaaataaataaaataaaagtaaataaataaaatgaaactggtctgactgctgagcctcatttacttccagcacaatgattttatgggtcaagggacaatattaatgtaagcagccagcacgctctcagcaggaactgacacaagttacatacccgtgggacccactgcatgatgagaccttcacgacaccaacagaactccaacatcattctccacccacctcacaaattggggaccattctgctcttccgtcactcaagaggacttgcaccgcacacaggacctacatgggtctcagctttttatatctcattttaagtaaaagcagatttttttaaagtgcattctcctcttacaagaacattaattaacttctcagctaaaactctgctgggaaatgtgaggtacagcaatgatgtgtctccatgggtaatctaaaagggaaaggaaataaggggagatttacgctgggaaaatgagagtaatactcagagtgtgaataatctaaagtacagacatttaatctgagagaaatatttggatattgggaattccaaaggagaactcagccaatgattatggtccacagggcccatgggtaggttattaagaaatgcatttacactgaaatactatgctacacacagacagcagagcagcgtaaaaaggtttcacacagcattcccagcacagacagtgacgatgtgctctaataactgggataactgcccacggtgggaccctaaacttgtttccggacacttcagcaggtcaagtgtagaagaaaaatttaagaccactaggacatggtaacagttgtcaccatttccaaggggaagctgaaaaagaaggtgagaaaactttatgtaaaactttatcaagatgacagaaattcagttctccaacgtcatccatttcaagttcctatagaaataatactgcttacccaagtcagaggactggagccaagaaaggtgacagagaagagaaatgaatggggtgggaaagaacaatttaaattacaggtcttccagaaataccttctacccagtcccaccatcctgcagaaatcctgaacaatcaaaaaactttcagctgtgatggaaaactcaactcaaactaaagatgggacgctctcatttactggcctagtgacatggccagccctggagccctgaggccagggagaaggtcagttgcccagataaaaagtggcgcccagttaccaaaggaagggaaatggatattatgcaggcaaaacagatacactggacattccattccgttttgtcttgcacagaaattaatgactcctgtccagttcctctttctacaggagctcacaatctgtcttcaaaattcacctaggctcctttcctctctagtgccctgctatacacccccattctgaattccccaccccaactcttctcccactgctgctcctacacacacaacctcacatatatcctctctctctctctctccctctctctcacacacacacacagacacacacttctctatcattttcttttatttcaggacttatttaccaaagtatcatggtttcaagtatgacagaactatgagccagtacatgaatttatccatcaaaaagtgctatcaaaatctttacctataatttcacatattaggtaaagccattttaactcaaagaaatgcatgctaatggtggaattttagatactttggcacattgggcaagcccaagaggacccttctcccaaagacattcaattcatgccacagagagaggctgcctatgaagtctaactagcagaaggcctctctcttttatccagtctctatcccatacacccaaacggctcatgaatgtggcagtaatgcctctacccagaaaagtaattcagtacttccaaaaggttattttaagacagactgttaaatgaaacatgagtaattccattacagtgttgattaggaacacaagtcagaaactgctccagacaagaaactcgtaaccacaacaacaaatggaaaacgaactccagcgtggctccctggagagaatcgaatgaactgatgggtgttttccttctcttatttccaaggatctaataaaggtttcatctctgtcaggaatggtgggagtctatcgccggggaagatgatggcagctctcccttggagctcttgcatttctgcaatcagccagcgagggaaagcccgcactccacaaaatgcaaggagtagaatccctccccaggtctactgactttcaactccagcaacctatttaggtcccttcatggtgcacacacacctcgtaattgactttgttttgttatttgtggacacatttagctctttcctctttctcttccatgagattacatatttcaggagggctccaggcagtaccttcattaccttgcaagtacatggcatatagtaggtacttaatacatgtttgttgggataattaatctgctgatttctaaacaaaagattgataaacaattgaatgaatggtcacacatggacaaacgaaagcacacttgccttctcaatcaagtattgaatgttaggttctgaaaactaactatagaaaatacagtatcaaagtatgtatacagaaaagccaaaaactgccacacagccttcattattttcctacaggcaacttcataggataatccttgcatcttggctcttcaacatttgaagagcacctattgtgatagcaacgtcttatcacccagcctctactgacatgaacaaacaatgaaagactatattcactgacattccccggtaagaggctaggagactagtgtctaaatgttgggttgctttttttcttattccattagacatttttagattctcagccaagcccagaagccaaccctcttcttgggaagcttcctgccagatctccatggggagcccccaggcagccatatttggactgggaatccaacctccactcatcgaccaagagcagtcacctgactcatgcttggcaaagcagagtctctttctaaggaaatgtggagctatgactgagagccagctagtcagtctctgtgggttcctgaaactgcagaacgagctaagggttattcatgttttctttcacatgaaagctgggctgcagagaaagagataatgtagcaaaaataaataaataaatacacaaacaaaaaaaaaaacaagaaaagcagagccaagacagagaggtaaactgataaactttcaggtccattcctaagtaccagtccattcttgcccaagtggcatgagctaaccctgtagctttattataaagaatccccccttgttcttttacttaagctagtcattaccagctagttgattataaataacatgtataatctaatttcctgagaatttttaaatcttttgtatgtttacgtgtgtgtgtgtgtgtgtgtgtgtgtgtgtgtgagagagagagcgtgcactcgcagctataaacacaaaactatttctttttgcgcaaactcccacaaaaactcggcgggagaggaggtaatctcatgatctctgcattaagccagcctgaaattgatctgtgtctctccgtaactcaaagccaagctatttaaatagctctcaggaaatgctttttcccagacaccagacacataataaatactttttttaagtgtaggaagaaaagaataatataccaccaacctgactaatcttatcacattcctgactcagtacagatgcaacataaaggctggcacaaagcgggtattctaaaaatgttaattgttgctgttattgttattatttacctgttcctggcccagtgctccccagcagggctagcatgatgggggcacacactgctgtgaccctaaatacattacggttgaaaaaattacaggattttataattttataaaatctctctctctctttctctctctctctctctctctctcacacacacacacacacacacacttctctatcattttcttttatttcaggacttatttatccaagtatcttatggtttcaagtttggcagaactacaagccagtactgagcaaggaccgaataaaattataggatcattataagagttagcaatgatacattctatgttccaaagaaatgctagaccacattaaatcaatgatataaactgactggttaaagttagtttacttttttttttttttttttttttttttttgagacagagttttgctcttgttgcccaggctggagtgcaatggtgcaatctcagctcaccgcaacctccgcctcctgggttgaagcgattctcctgcctcagcctccaagtagctgggactacaggcatgcaccaccacacccagctaatttttgtattttttagcagagatggggtttctccatgttggtgaggctggtctcaaactcctgacctcaggtgatccgaccgcctcagcctcgcaaagtgctggaattacaggcttgagccaccgcgcccagcctagttcacattttctaaaagaaaaaaaaaaaagtcaatttcttttttattaaagagaagcaacataaaaatacacagtcacaacagcattcaaggaaacgaaaccatcttcattcttctgaaagaatccaaaaggagtgagaggtgaacatggcatttgcacatatacctgaactgacttccaagctatcctctttgtctcaccaagcgccacacccccatttctcccagcttgttcatgaatctagcatggattgggtgaggcctgtaacaactgaggctccttttattgttcactcctcaactggctgctccaggaaatcctacagcatggcaaaaccatccttaagcaaaagctaatggaaggcaatttgggggaaaaggaagaaaacaaggaaataggaaggagatgcgaattatgaaaaaaaatgaccattaagaaacaaatcaaatggacaaaatgagcttctatttagggcctatgaaattagcaactactcagaaaaaatatatactacatagtaatggtggggatatagaaaaagagcagtctcagagttgactatgggtaagtaacttgtttcaacctttctgggaggaattttagcaatgcacatctctttaacatatgtatcatctttgacccagccattccacttctagaaatttatcctacagaaataatgagaaatacgcagaatgcttagggtacacagatgtttagaacaattaaagtcataaaatggtatttataatagggagataatggtgccaatctaaatgttccatattaatggagtggttccctgaaatataacacacataattaagtccagggttcttcaaactttattctgaaaagctcaatgagtctctcggacatatctaaaggtaccttgcaggagtaatgaatgaatcccaatagacaggtcttgctcccattcatcccagacttagccatcctcataaaattatgggtacggaaatgatgctactgcttaagcagcaaacacaaaatggttagatgctaaggactattatgcagccattataaatcatgttacataaaaatatacacaaactaaaaagaacaagtggcaccccagtatctagtaagcttcagaggagatcgggtctttagtagctgctaaagatatagattactctgccagacacagggtgtctcatcactaataaactcctaatagtgggtatccttctttcatattcatctacataaaacagtcatgataaaattcattctctaaggtggtagtaaaaattagttgagatgatgcatgtaatggtgtttacctcaatgactggtacacaatactccatcatagaagttcttttaatgtatatcaatctaaggcttagaatttcacatttaccagtatttattcctcacctctcattcacacagcatttgaaatcatcatcagctcagacctcctgactttcatggaaggcatccatgaaatcaagtcttttaaaaagtcaaaaatgatttctttcgcccagaggattccagtctttgaactacataatttggattttttgttctgttttgttttgtttttcagctaagaaagcaagcacttcatttcttaagcaaccgcacctcagcactaacaaccccagcagactatctttccctcaaaatcacaggactgctcatagaatgctcagagcatcacagaatcttacagaactcttttataaagaaaaatatggctgtcatctttttatgtctctaagaaatgacaataattcagatttcaattctatagtgatttgatttgatcattttaaaacaaagacataaaatggttcatttatataaccagttgctaagagtgttggcattttaataggcagcttatgaaaacatactttttgaaagaaaatactaatatctacagagaggaaaaggatgaatgaagctcataaaatttaactgcattttagttttgatttgggaaagctgcaagatcatccacttgggaaacacagcagctgtatttctaagtcctgcctcgtacagttccccaccagttgctgccatgagagccccttctctagagggaggcggcagcattcgtatctgctctctccctgcaacctgtgctgctgagctagtggaaatctcaatgattcaagggactgaatagaagttcctttcgtcaaaaagtctgacaattctggggcccatgatctgggaatgaaatatctgtcctaatccagcctggggccaacacacggttgttgattgctttaaagaacgaagcactaccagccttagctgtttctcaagagaaaacacctgctaagggcattttcattcattccaactgagcagtttcaaggatctaaccaagaaagcagagcaagcaacttctggtagataagagcagactctatagatgccttcctacgccaaaatacctacccctcccccagctcacttgaaaggagtgcctaaattcccaccttaattcgtcattggatatattaaagaaaatatttaaaagttccctaacaggcagagcaaaatccatgaagtcaaatcatatagtattatcttagcaagaatgttattttaaaatagcatattctatactattaaacatgtaatattttaaaatatattttattacttgtcatatacatttgaaatattaaaattatatcataaaatatatttttattaagggcttatgtgccagagactgtcaccagtgattcatataccttatcttaattaatcctcacttgtttcaaggcaggtaccagtgtccacattttacacatgaagtaacaaaagcctggactggctaaataactaaccaaaagctactcagctagtaagaggcagaactgactccccaacgcagagatctaacatactccactgcctctctctaagcagaattcaaaggaggacaaaggaaaagaaaggtactaagttcaggagacactgatttgtatattaaaaaataaagtattattgtctacaatggtagttgtgaaagttggcagctgattggaatcactgagggcattttttcaaatagtggtgcctgggtccgagccccctccccctcccaattctgattctaattggcattttcaaacactccccaggtgattttaatgtagagtcatggttggaaatcaccatctagaaggatttggagtagaacttaaacgttcatagaggacgcttagtgaacaaacaaggttttagaaatctctagaacaggactatccaaaaaaaaaacactttcagtgatgaaaaatttccataatctgcactgtccaatgtggtcgccaatggcaacaatggctactgtgactaaggagatgaattttacatttcatttcatttcaatgaatttatatttaaatagccacatggggtagtgggaactgtactggacagcacagctgcagagatctgtcaatgtgcctctgctttattgatgaaatgtgtcaactgagatgttgaccgtaaacaaagtggcaagtacatgagctcctactgtccatatcaattatttgacatgaccgattgtccaaaatggagctttgttaacaagtcagatgctctgagtagctaacaggggaaaaaaaaaaaaaaagatcaatgccatggaaaatatgtcaaatatatttagctaaatactctttaaggacataattcttcaggtcagtgttaatttgctccctataatgcaagaaccagttgctagccatggccagtataaatgccaatatcatcaccgtaatgcagaggaaagaagagaatttagggatgtaaaatgttttgtcaacaacttctgctgttactgtgggtcaaaagaatctcttctttcatcttcatatctttggcacctactccagtacttcaaatatctattcaacggactaaaaaataatttaatgatagcggaataatggagcatttatgcattatcttgcatattgtagtcaatcatacatgcagaataaaagggtttggacataaattgcaattcataaaaattaccaatatgtctcacttttatttcaataaaaatttgtttcctacttaggtgcataacatgcctgtgtaccgagctattatacattccttaatttgaactacatgactacatatgtcaatggactaattctgaagatgtgcatattccccaaaattttgatatagaactatatgcttttttaaaggtctcagattatttgaattttgtatatcagatgttcacatatattatatctgaacttaatttaatttagaaatgctctgcagtaaattatacttagctaattgtacgtataaatccctccatagttaaaaataattttattatattctgaatggagcttgcaaaaaagaagacatcatttatggctctacatttgcctttatacgcagtaatactaaaacccaggcatggtaccaatctacatgaaaacaagagcttagcttcaaaaattaaactgcctggagaggaaaagctaaaaacatactgatatacttcttggtccaataatatactcgcatttcctcccatttttccaagatgaagccaggttaacaactgagtagtgttagaaaagaaagagggagagtgattaatgacactgaaaatgtgtaaaatgtgctcaattcatcagttgctttgaggacacaactcttttggaccattcctattctgctctatgtcatcaaagtaacaactactgctgtggcctcagtaaacaccacttttatcacagtaacaaaaaaggaggctttgcctgtgtttttaagctaatgacattgcaaatgtaatagaacaagacacaatggtctaataaaaaagaaaagctaatcgtaaaagaaatttggactacgataatggcttaaaacagtcaattccaaagcaagagaccatggtaactaattgttccattctagttacacagggaaagccaaaagacataatgcattaactgcagttagaaaacaactaagtaaaattatgagtgtgtgtgtgtgtgtgtgtgtgtgtctctctctttgactttcctttgttaaagagaattatttttaaatctgcagtccttaaaacacatacacacacaatattctatgttactcaaacactgtcccagtccagaaaacactgattaattagtcctccatgagttatcacatacatttttctaccaagcattcactgtgctattttggttagtttctatgtctgtctcaatttaattcaacaaatacttactgaggctccatttgccaagcaccataccaggtgctggagacctgataataaacatggtaagtttcctggtctgatggaacagcatctagatttacagctgaataaagggctgagtgttaaagagagtaagcacagcgtgcagtcagaacaaataggggggtccaacccagacgtgggagaaaggaaagacttcccagaagatgcagcccaaacagtgaatccacgttagccacagaagatgcagaggggcagagggtaaggagttgagagcactgctggcccaagaaatgccttgtacaacagcgcagcaatggacaaaacactgcatgaaggaggaacccaacgtttaataactcaaggggaaggcagggagttcaagatgaggccagagaataagcaggaagtagtcactgaagaactcatacatcttactgaggagtttcaacttttattctgagagcacgagggcaccagatttgagttttataggacaattgttacagcagccttgcacagagaagactggagcgtgcaggaagccagaatgcagaagactcctagaacactagctcccagaaagtagtttatcacggctcaacaaaagatcaataacgttgattgaattccattcatactagaaaacatatctatttaactgtaccctcagaaaaatttataattctatcatgctttattaacaaggcatatggtccaggaacagtggctcatgctttgtaatcccaacactttgggaggctgaggagggcggattacaaggtcaggagttcgagaccagcttggcctacatggtgaaaccccatctctattaaaaatacaaaattagcggggtgtgttggagcatgcctataatcccagctactcaggaggctgaagcaggagaatcacttgaacctgggaggcggaggttgcggtgagccaagatcgtgccactgcacagcctgggcaaaaagagtgaatgaaattccatctcaaaaaacaaacaaacaaacaacaacaacaaaataaacaaggcatatgatctcccagcaacagaatatgcgattttaactgttttatcattgcttaattcacttgacctaaattttatgcactgtaccccttccctccaccctcacattggtcatcctagtgaccaatgtatacaagtgaataacagcaggacagttagggctagagagatcttccttcaaaccaagttaactcatttatttacaaagttgattacatcaacttaaatgctgaaatccaccccagcattaaggcaaaaaaaagtaaggttgaggctgggcacagttgctcacacctgtactcccagcactttgggaggccaaggcgggtggatcatgaggtcaagagatcgagaccatcctgaccaacatagtgaaacctagtctttactaaaaatacaaaaattagctgggcgtggtggtgcatgtctgtagtcccagctgctcaggaggctgaggcaggagaatcgcttgaacccaggaggcagaggttgtagtgagccgagatcacaccactgcactccagcctagccacagagcaagactccatctcaaaaaaaaaaaaaaaaaaaaaaggaaggttgaggaataaaggctgcttaggtcaacagaaactatcaattcagaaattgctaagcagaattatgtatctttatattaagcaaatatactgcactggcatgtgtatataactcaagaatcatcccactggacaactgggatgttgtcccagcattttattaatcagttgattgacctttgaacagacttactagaatacctgacaatcagcaaccaaacagaaacaaatctttacttccacacaagcaaggtttcaaagtgagaaaaaaaaactgccacacttgtaggcagtgttatttactgtggcaatttttttcagcctttcagcttgcactgcatagaatttaccattatcagggagatcctcagagaggagaccctggtgcttttctgctacagttttagaagcttgttcattcattatcctctgagatttatccaggatttcttgctgtttacagcctatctgtggtgatcacatctcatctccagtcacatgggcagtgtgatcctccatgtcaaggggctgatggatacaaggggtagttatggcatagggatctcttttaagtcgaggagtactgcgtccaccctactttagaaacatacacattaggcgtccttaatctttcggggtcatgagcctatggtgtcacaactccctagaatcacaaaatattgaaagcaatttcttaagtctattcatgcacccctcaatgtaggtggattacctaggattcttcaggtcacaagaaaaaggaaatctaaatcaaactaactcaagttccctaacccccaggactctgttgtcttaagtaaataatgtgcttcaggcacattttgagtagtctgcatcatcaaggctctcttcacttggggctttatttttaggaaccctgtgttagtaccatagcaactaactgttccaggtcaatatcatcccagattcaaggccacaggaaagaaggtggtacccttctcctgacacaccaacaaaactcacagtaataattctaatttttctgactgggtcacatgcttgtccctgaatcaatcactgtaggcaaaacgatgttattctctatttgcccaatcttgggccacatgctgaccccaggagccgggggtcaaatctgcaaaggaaagggtggtggtagttaaagtaaatctaggaggctcttgggggaagacaggtgcatgggtgctagttacaaactcccaatctacagactgaatttaagtagactaaacctttgcattggaatcttagtatcacaggattgtagaactcaaggaaacaaagtgatcttaaccagcaactctcaaagtatgaacctggggtcctggaggtcctgagaccttctctggactccccaagattgaatcattcccctgccctgtttcaggccccgaggtctgccagagtttggtcatagcatatatgtttatgtgactggtatcctccccatgactacaagctccatataattaacgtccacgtctgccatgtctgctgcatgcctggcatgcttcctggaagtcaacagtgtctcctggatgagaaactgaatacattaaaatacagccataacacctggatatttccttggatctttatctgcaaatgctttcttaccaagtgaaccactaaagactttgtcaatccaatcttctcagaggtctaagatgttacaaaagtaaagacattggattcttacccaccagcatggctctagcagctattatgacaaagcacagaaatcactccgaacctacagccaatgtcaaaccaaaagaagcaacatcatcatcacaatacagtcatcaatttacctgggcaaaggggatgcttggttcccctaggacttcacatattcagatgtgggcaaaatttaagacaagcagctaagataccagagggcagagagtgagatgtcagtgatgataaggcaactcaaaccctaacaaggcatgatggcttagacacactaataaaccctgagacaaatatgatttttcagaagttcttttccacatttcaagatgaccatttcaacctgaccagatcactccttttattcattcatacaaagatggaaagcatcaagtgcctataacacctaccaacctaaaggaaatacaaagagcagaggaacatgtaaactaacaccacagggatgggatcaggtaatccacactatgggaaactacagggcaaacaacccagtttcttcaaatataaattccaggaagaaagagagatgaggaaggtcaggaaggaggggagaaatgaaaaaggaatttaatagataaaaagaaacataaaagaccaattgtattagactgtatattcagttttgtatattgctataaagaaatacctaaatccaaggcaggcagatgacttgaggtcagaagtttgagaccagcctggccaacatggtgcaaccccgtctctactaaaaatacaaaaattagccgagtgcggtggtgcatgcctgtaatcccagctactccggaggctgagccagaaaaatcacttgaacccaggaggcggaggtcgcagtgagttgagatggcaccactgcactccagcctgggcaacagagcgagactctgtctcaaaaaagtaaaaaataaataataaataaataaaaagaaatacctgaggctgggtaatttataaagaaaaggcgtttaactggctcacagttccacagggtgtacaggaagcatgatgctggcatctgctgggcttctggggaggcctcaggaagtttacaatcatggtagaaggtgaagggagagcaggtacatcttacaatggcaggagtatgaggaagatagagtgtgagggtagaggtgatactcacttttaaacaatcagagcttgcgagaactcactattgagaggacaggacctagtgggatggtgctgaaccatttgtgaaccattgctgaacctgcatgatccaatcactcccacaaggcccaaactccaacactggggattacaatttgacatgagatttggtggggacacagatccaaaccatatcaccaaccaaatacaatgtgtgcacctcacttagatccttattcaaacaaagagaaaaaatattttgcaacatttggcaattagtaatttgaatactggatatttgacaactaaggtattacagctaaattttttaactttaactgttttaatcacatatatttaaaatacccctcttagatgtaaatattgaaatatatatcatataaagtgatttgacatctaaaaattatttcataataaaataggaaggatgaagctagtgggcctggacagaattaagcagagtttgcaaaagtggatgacggtacaatggggtgtcttatgttattctgtctactctttctatggtccattatattttctagaggaaaaggaaaaaaacttcctcaaaagcagggatgttagctatcttgttctgttctatttccagtgcccagcacagttcctaatacatagtaggagctcaataaatatttgttaaatgaaagagagaacatttcttattcattccactagtccaaggctcatgggagcaatgtggtatgccatataaagctatataaagccttccacagcctgcttctcctgacacacacattgcatacactgttgtcaacaacctatctttattctctttctcactgtcattactgttacacctccaggtggcttctcctgcagtactgacagcttttatacctaatctctatttttatgagaaggcaataaaactgagaaaaatcctacccaaagcaatctacttttaaaaaataaaaaatatttattgagcctgtacaatgtgccagagctgacctataagcactgaggatgcttcgtataagcactgaggatgcttcgtgaaccttccatttttaacgatggacacacacctccttccccagtttcaccatatgagaggtcatagtgcacactggactccagaatttaagaaactgggtatgaatcttggttctgccacttaccagatggtaggacattgggtgaattatttaaactgtgcctctgtgtcctcactgataaaatgaagaatcttttaaaatctatttcctagagttcctaccacaatgccaagtacaaaacaatcaatcaggttactgattatttttaccacacaatttttttccttaggaaaattttaagaattgttttcattaaaaaaggaataaaagttattttgccacgtcacccatgcctagcctacgtccctgtgaatttggaacttgacataatttcaggaatccctgctctgccttttccctaagcccatgtgggatcttggaggacggatgtaaataatggccagagctgcagatgtgcaaatagtagggcttgctttcacatcacatctggcctgctttccaattcctaggtggccaagagtgattcacaagtccaaagcaacatgtcttcaatgaacatataccattacatgagtgggagaaaaacgaggggcccagcaggtatagaggccccaggtgaattcccaaactacagctgttagaaaacatgtgaacggtgctggagaccttaagaaagctgcatatacaagccaactaagttgtagaaagaatttgtgtgtctttatcttcaaaaataaatctgtcctctgctatcagctgacccaatctctttccaacattaatgaattcatgaattgaacaaagagacacagtagccctccattccctccttaagttgtctgcctaaataccttctacatctaatgcagcattcagagcttgggggttttacccagaaaggccatgttactacaagtcatggctattttcttgcctaccaataatttaacctcttagtaagttataagaaatatctctttactgaaaaatgtcatatttttttctgtcttaacctcttttgctaccagacaccaaagcatctgtgggaatattttaaaatgttgtaagagtacatggatactaaatacttcaaaattattccctgaaagaagcatgtctgtactccctgcccccaatgagcaaacacacacacaaatggcttacggtaaaacacccataaagtaaagaagagggaagagtaacttatcttcaaaagcgcagacacagaaaatgtatgaagcgctcttagaaagcatattggtctgagatgttttaaaagtttatctttgaaaatctaagcctgaggttacttttgggaaaactaatttaagcatgaaaagaagagagcttatagcttatcaattaaacattttggcccatggcacattctttttttccactaacaggcagggactcttctcatctttagaatctatctcccatttgaacaatacttcttttaaagaactatccttaaaatcaattatttaaatactttaacctaagcagtggttgtgctgaagctggcttgtattggctcacaaaagtagcacttctccccaacttcgcattcagtgacttcatattggtagtctgaaatcaaccatggtggatacattgacaccatggaaatcggcaagtgctataaatcagagctctttcttccctagagagtcagtagttaaatacttcctagctactagtgaggctaaaatgcccatcaaaagggaaatgttaaataaattatggcacagttatgcaatggacttctaaaacacctaaaaggtaacataaaactatatattcatcaatgaggaaaggtgtcaacagtatttttaagttaaaaatatagataattttcagccaggcgcagtggctcatgcctgtaatcccagcactttgggaggccaaggcaggcagatcacgacgtcaagaattcgggaccagcctggccagtatggtgaaaccccgtctccactaaaaatataaaaattagccaggcgtggtggtgcatgcctgtagtcccagctactcgggaggctgaggcaggagaattgcttgaacccgggaggcagaggttgcagtgagccaagatcgtgccacgcactccagcctgggcgacagagcaagattctgactcaaaaaataataataataaaatttttgaattttatatatatatatgcatatgtattttataggtataccactttagtagttgtatatatgtgtagatgtgtatgtgcacatatatacatgcatggtatacacatatacatgcatggaaaaaaatacaccaaatggtaaaaacacattatcaatgactggaaggattatgactgaattctgtttgcttaattttacttttctgaattttgcaaagtttttagaatgaacagctattatttcataacaggtaggagatcatactaaaacttaaataaaaagaaatcaatattattatactggcataagcatatgcatttcaatgccagtattatgagctacttatatttgggataagaagtagaagggaatattatttttaaacatgtgttgaaagagactggatatcagcattctgtgcaaattcttacctgttacttgtgcctaaatgagctttcatctgcctctgggctaattaagtatggctactcagtctgatgaaactttgaaaacaaaacatatacaattgagaagaatatttttcttactgaccttagttattattacatatgctggccttcatcattcaacaattggtacattttgtgcccaactcacaagaccagaccagcctgacatttatcagcatggattttaaaaaattgtctctaattacattaagggcactgtattgagacatcaacgcttttgcaattaggatatgctaaccatctcagatcctccataaaccctttgtagtgggttttaaagatggaaaacacgactaactttagatttcaaatagttctctttctaacaatttttaaacacattatcaataacattactgagaggaataaggaagcctttaaaaataaataaaaggaaattcatccattctaatagcactgctctcagcaatgttcttcagtttctcctcatattacctgacctgctctaatatgaatttgtgccaccatcccccggtctgctgctccaacaatgtttccttatttctcaaagaagttcagcatcaaccttggggttcactttctataatccaaagtaatcacctgattaaaggtttttaaagtaaggatttgctttatccagtcccaaggaaccaggggctggttataaatctaaactttcacaactatctgggtagctctccttttttttctttcctatattctgtgcttctccctgatacaggaacaaaacagcaacattcatgaccaagagcctaagagactttcagaatgtcgaaagttgatgccaaattgggaagtaagacagtaagtggggaagacgtaggagacaaaaacaactacttccatttattaatcactttacactatgctaggcacagcacaaagaatattacaaaaaaaaacattttaaagtctctttatgttcataaacctcttcaagaggcaatattatcacttggaacttagcaaaatgacataatgccaaagtcacacacagctagttaacaacacagccaaactgctcttgctccgaagcccactgccttaagctctatactctgctccctccacgcagtccagggtctaaactttgaaacgccttggacctaggatggctgaatcaaaagggtcaaacacagatgggtcagacgcacccttacttcaaggtctactcaactacattctcctacaataaagtcccaagctacaaacttttggcatggaagaagctgcataatgttattgtgataattattacagagagggatattttttctcttgtctcttgtcagtactcagaagtatatttatattcacatttatataacatttaagttattttcccattatattattctaattgcctgcagcaaaaaattttttaatgttatatgtaaaattaatagcatctttatgtctatcatgaaaacagtcaggctgaaatccatccaaaaagattccctgaacatttccttccagatgaaccaggaaccactcactcactcacacaaaatacatgttcaactagagttgattttataagatattaattaacatagcttcattctgcagtgacaagagcccatctgctttcttggcattggagaagtgatggacttcaaatcagcttaagggaggcttgagtctggaatgatttccatctgcaactagttcttatctagttctacttttcactgttaactcagcatatctcatcagacttcttcaactggccagaggaggaccatcaggttctgtccaaacctggtgaacatcaagcaccaacatcacaggctaactgtggagctgaacttttataggaggaaggagaaggtctatcccacaataagatttctcaccccccaaactcaaacacttttttatggctaaatccagtctctgcactgttgtagttctccagggtagtatatctcacatctatgtattctttaaacagccccttttttcagttagcagtaagatgggagactgaaagaaaaggaatgagccctattgatgtcactaagtggttaatgataatgctgtactttccaaaccccaagggcagaaatctaagcaaattaacacagtttcaagttttaaagtcaagtaacaggctgaataatggccccctaatgatgtccacgttctcatctgcacaactgcaaatgtgttaccttacattacaaaaggattttgcaatttatgataaagggtatggaccttgagatacggggattactctggattacctagtcgggcggatctaatcacatgagttattaaaaactgagaacttttcctgttctatcagagagatgggacagaaagagaaaagattccaaaaggaaaaggagctcaaccctgctgtggctggctctaaaagcagaggcagagggccatgagtcatggaatgtgggtggccgctagaggctgggaatggccctccgctgacagccagcaagaaaaaggggatcttggtaccacaaccacaatgagctgattttgccaacaacccaaaaaaccaaggaaaacgatctttaccccagaacttttaaaaaggaacacagccctttcaacaccttgattttagcccagtgacatccacgtcagccttctgaccttcacaaatataaaataataaattgtgttgttttagccattctgtttgtggtaattcactatagcagcaacagaaaattaatatataggctcaggcaaaatgaagagcatttctgaacaccttcttagcctcttggtctttaaaatcaaaaggaaccaactgcatagtgctatggtctgaatgtcagtgtcctcccaaaattcctatgttggaacctaatacccagtgtgatagtatcaagaagtggggcctctgggaagagatgaggtcatcagggctccgctctcacgaatatgattagtgctcttctaaagaggctcaaggttgctttcttctaccccttctggcatgtcaggaaggcacaatctatgacgaagaagacctccccagacatcatatctgctggtgccttgatcttggacttcccagctcccagaagtgtgagcaataaatttctcatgcttgtaaattacccagtctaaggtattttgttatagcagccctaatacactaagacacatggtatattgcttacaaatgttttttaataagcatgagagttgtacaaaaccccatttgcaacatctgcaatgccaaagacagctgtaggtgttggggaaagtctctgagccattactctcaaagatattaaatcattccagactattctgaaagccaaagataattaagcttgatcaggaatctcaagtttttttccagtgtaatatgtttgtataatggcaaaactatggcatggatccctacataaacagttgtgctttcagtaggtgttgactgactctccctccaattctactttggattcagcaatgcttacaaataaactgttttattagtcacaacggtatctacatacacgtgaaaaatgacattccagacacacgtgagatcattatttatgcagatgaagcctggtacacatacagaggcaaagatctttctgagttctgaccaccagcactgcccagatctttaatatgaaagccagtgtcgtggattgaaaactaccattaaggtcttggcacatactgtgtcagaggaaacatctgtttgaggcatcgcagttgttctaatttccaccttaaggataagtctgattttggaatcaaatcttcctgaggctttttgtgtaatgctaaaaccacacctggggaaaatcttataaaaggagagagagaaaaaaaaaaacacagagagagagaaagaaaacatataaagttcacttccaaataaagacatggggtagctatagctggcataatttagtttatcaccaaccaaccaatgattggttcaaccacggctccagtaacagctctcatgcaaaacacaaaatatgtttaaatcaatgctaagttaatgggctgccacaacacaacttctctcagtggacactatttcacaccagatttccatagccagattctgtatcagactccttatcaatagaggtgccttaaacaagactgacttatatttgctaacaattttccattgatttatgattcacagtattatattatgcaatctgttagacagattttaataatcagatgtgtccaagtgatgaaacatgggactgcttgcccaaactttaccaaggttgtaataccctccatgttttcagtaaggtaaatataaagaaacaatgggacctccattgtttaccaggagtcccacttgtgacatctgctaatacaaatgaaaagatttatagtattaaactgaagcaaacaagcatgcaaaactatggagagggtgacattgggtggttttagaaaggttacacagtatctttaaaatgtaaactcatttagactctgccagtaatcagctatatgtacttttagcaattggacctctctgagctccaattgctaaatgatattcccctttatttgtgaaatgaggagactggtctgcatttgattctgcattctaaattcatgaatgctaagtgaattggcagtgtccctaacaatgacctttttgtcctgttcctcacttctaacttcaagctagaaaccagcacattactctgcaacttgccactgacttaatggacaacttcaagcaagtgtcacttccccaacaagcttcagtttctccttcgctaagagcctcctccgctaattctgaggaagatgaacagggccacctggcaaaaattttttacagaatacaagtagcgttacctggatgttttgcatcaaaaactaaaacaagtacaggctgaaacccaaagctagtgagttcaaattcctccatgcttttaaggatggagcatgtgaagagcagaagtatagagataaagcatcttattgtataaccacatacacggttgaacttaaccactcttccaaagtacacaaaacagcacacttaatccataaaggagatttgaagactggcctctaactcttgaaagttggcatgctaccactataaaaatgccgtttttgaactaaaaagcaaagacctaaatgactcctggtcttacgattcaggcaggaaactcatgaggccaaaacaaaaaaattccacatagatttttgcaaatatttaaaaagcacctactggagagaatttacttgtgtgaatggaagttttagataaaatgcctctctgaaatacatttgctttaaagagaaaataaaaggtggcagtctttactacagatttgaaatttaaaaaggcaaatctgaaatgtgtcaccacatatgtgggccacaaggttacagcttgccaaagttgcaattcacatactttacccattcctggacttactgaatgttgagtaataattgtgggggccttgcctttcatattgcgccaataatctcgagagaccttacattaccatttatcaggaggtctttaacgttttgctgtcatcattcaagagtgccttttggtctctgatgtttccaaccagccctctttttcagagcacctttctcttgactgcccaaagattaatgtttaattgcagctggaaaggcaacaactgcacagccatcagcataaatcacagtgcagatccactaggcaccacatttaactggcagaaatgatgtctcccaatcagtgcctgcaaatgcagctggttctgtgcagtctttgtgccttataatttggttaagccctttacaaatgatgccaagggaggggctaagagagattcttcaaaacaataaagacttccagtgtggttttagcacatgtaatgaaactgaacacactgaaaagaaaactcctagggatggagaatcacaaaagaataaaaggcttacagcaattcctcataaccaaactgctagcatgtctctgaatacgacatggtcttccatgcctatctgcttggcaagtaacttctgttcattcatctttcaagactcctggatgaagctagatgctcccttctctgtgccacaaaagcactcagcccaaagcttctcttccaacaattaccatgtgttttggagccattcatttttctgaccatctctctcagaagacttgagcctcttatttctatacctccacatcctagggcagctccaggcatacaagagatatttaatgtttactgaaatgactacccatcaggcaaagcatctgccttcaatctaaccatcatggtctctatccactttgatgaaaatagcaaaccattatggatactattttgttttcaagtctggttattattactcaatgtgggggagcttgaatcctactcactgctttcacccagtatatgactgtatcaaggaagcagattaaatatgcattcttactacatttcactaaaattctcacaagaattctacaatggtgcaattatattcccatttgtatggatgaagtgaatgaatggagcttgggaaggtaaataaatgacttttccaacatctccaaacaggtcaatcagtaatagtgggctaggactggaatggaggtctactgaactttttttttttgggagacagaatctcactctgtcacccaggctggagtgcactgatgtgatcttggggtcactgcaacctccgtctcccggcttcaagagattctcctacctaaacctcccgagtagctgggatcacaggcgtgcaccactacgctcagctaatttttgtagttttagtagagagggggtttcaccatattggccaggctggtttcaaactcctgacctcaagtgatccgcccgcctcagcctcccaaagtgctgggattacaggtttgagccaccacgcctggcctaggtctactgaacttctaacacccatacaatacaatctctccggcttccccagtagcatcagagaccaacagcatagttacaactccaattcaaaacagaaagactgaagatgaactttcactgaatgtgcaagtatatgttcaaatatctatttactagtgtaatcatcgacgacttacctatttgtaagtctttactatgtcatataaaatagagaatattcatttttaaattccaggctttatgagatttttgttgtgttattacaaccaacttgaagcaagtgccagcttttttccacaagttaggtggcaggcttcagcatgcttttgagcatattcaacctactacaatctgagctcccagaaaagtttccttaattgagtaaacaattacatgaagccaaaagttggctgaagagagaggggctagatctcttagtttcatttgcatgcaggaaaaagtttatgaactttcacaagctccccagtggctttctgtagcagtgaaaatatctttagattactagtacacatgactagctatgtaacagaaatctacagtccatttgcaaattcttactcagcacctacttccctagacactggggatcctgtggtgaacacaacacatgtaattcccacttttctgcagctgaaattcttatgcctaacaccagctgatagataaacaacaaaggtaacttcagataataagtgctaagaagaaaataacaggacggtatgaaagtaagaggaggtaggaacatgaagatattagctaaaggaggttctgtaaaggctactttagattgggtaattacagaagtttctgaaatggcattgaatttaaagctcagaatgaatcatccaggagaaaaatctgagggaagagcattccacacagaaacctcaaacagtgtgaatgagcttaacatgttcaggaaatagctcaggaagtccaagtagctggagctatctttctcttattgatttctactttgattccactatggttggagaatatactctgtatgatttcagttcttaaatttcatgctttgtgttactgctcacgatatggtttttcttggtatacgatctgtaggtgcttgaaaataatatctattctacttttgttgggtggaaggtctataaatgccaattagattcagttagctgatggtgttgagttcttccacatttttgctgatttttctctctagttgttctatcaattattgagagaggggttttgatgtctacaactataattgtggatgtatctatttcttctttcatctctagcagtttttgcttcacatattttgcaggtcttttgtttgttgcataggcatttagaattgctatgtcgacatggtggaatgacccttttatttatcattataaaatgtccctctctgtctctggtaattttacttgctatgaagtctactttatctgacattaatacagccattactgctttcttttgattggtgtttgcattacacacctttttccatccttttactttgaacctgcctatattgtttcatttgaagtgagtttcttgaagacagcatatagctgggtcatgttttagtccacgctgccaatctcttgtctttcgactgatgttcttagagcatttgcttttaataaaattgttaatgtgttaggtcttaaggtttttattctattttttgttttctgtttcttctctgtttctcttttctccaatttactttttctacgttgttctgggttgcctaaacttttttaaaagctctattttggtttttctacaatatttttaagtgcccctctggtataatatttattttactgtcagggactaagtactatgtaactaccttattcacatcaaggaaacaagaaactacagttatatgataaggacgttaaaaaattcattatttcagacttgtctggcaggaagagaaaatagtgttaaaggggccacttaatagcaatgacaaatgtaccagcaagttaacttgtatcaagcaagtagagaaaatattcactttcaacccaaagccaatgaatttcctaatcccatgcatttgcatttcctgagtttctgattcttgccactttaacaaatagaactcatgagtatgataaaggccattcgtgataagccagtgtttgaaaacagatgactatatacaagaaatcaacgactctgtctggtgtatttactttcattgccagataatatttgcactaatattatatttttgtagtgaaaaacaagaaatctaaactatttaaatgtaaatgagaacattcttattttacactatttacagaccattatttggcagatttaagaatttatatttacaattttagcaccctctgcaccatatatagactctcccgccctgtgcttgaaaccagaatgcagcccttctgttcaatcgccctgtttctcccttgcagattacattaagcaccttgtttattcctgttttaattataaaaattggtatggtagataagagatgagagcagaactgaagtccacatcactgcaggcaagcaagctgggggttacctgctcaactgaggacccaatgtcaaggcacaagtttggtggcttgtggcatctcatccacatttcccaaggggcacactgctgtgctgtcatctaccaaccagacattgcattgagcaggttgtcagaccaaagatggaagggaggtacaaccattcccaagtaaggggtaaaaggtacagtgcataacattacaaagccaaagaaaaaatgatgtcatcattgcaaaatgtgaataatttgctccatgaacacatgcaagatctgagtcagaagaataaaccactctactcagtgatatgttggatggtaacaaagaaataaatctaactctgcaggcacagtataatgttcattcacctttctggtttcttaaagaatctctaaagtataaaatggctgaggactagtggcttagtgataaggatcgtgaataaaggacaaaaataaggaagcacaggacaaagacaggaccagataggtatgacgagaccaataggaaagatgatggttgtctaaagaaagggaaagaggccgggcgcggtggctcacgcctgtaatctcagcactttgggaggctgaggcgggtggatcacgaggtcaggagttcaagaccagcctggccaggatggtgaaaccccatctctactaaaactacaaaaattagctgggcgtggtggtgggcgcctataatcccagctactcgggtggctgaggcagagaactgcttgaacccaggaggcggaggttgcagcctgggcgacagagcaagactccatcagagaaaaagagaaagagagagagagacagagagaaagagaaagagagaaagagcgagctgtgctttttgtggagccatcacttttgtaaatatctggtgccaaaaacaccacacctgcaatcatctgccctggctcactgtctttgaaactgttaaattgtaatataaatgggaggtgttataataacaagaataatgccaccatcttacatacctgtgacctttcctcacagataggtcctaaatgtgacaccttttggaagaggttcctaagaagtaactactgacaccatcaagacagaaaaaatgaaggttttcttcaatgcaaaaaaaataaaaaaataaaaaacacagaacttgcttctccacgaagtattatggtacctcagctccaagaagacacaggtaaaatatgggaatcacctcctgctagaaataattccaggcaaaaaggcagatgtgtgcctgcctggcgctgcccacctccatcagggctgtcatttctacagcagctgtctgaacaaccccacagatgagtatcaacttcagctgccacacctgctgacggaagataaagcacaatatgaaaatagggatggttgatgccacgacctcccagagataggagagttcctggaattcttccagcaacattctccactgcccacacacctggaaagtcagatgaccattatatctgtccagctcacacaagggaaccataaccagtagatgccttcgtcctctgcttctataaaatatgccacgaccccacccagctgcttacccaaccatgggggccaacgtcctgatgcttggtaacagtgagcatcttctctaaggtataaacactaaatacgaatgcaaagcgcgaagtaactcaaatttgccattttctttctttacatttttctttttaaaatcacaggagtggtttcagtcagcatttaaatctatgttggtctgttttgctcatctctggtgtcctgtttgatatttttagctagttcctaaaaggcacaacctcaaatttcacacttccttattcgtctttaaaggtctaatacagggtttctcaaactcagtttgaccaacccatgaaggtcttatttttaaactttttattttgaaaagattttaggtttacagaaagtggtaaagatggaacagagaagttgtgcatacccttcacccagattcccccataggttccatcttacataaccgtagtacaacttcaaagccggaaaactggcattgcaatatttgtgtatgagttctatgttattttatcacataaaggtttgtgtaaccaccaccccaatcaagatacacaactggctgggcacagtattttactaaaaatacaaaaaaattagctgggtgtggtggcgcacgcctgccatcccaactactaggaaggctgaggcaggagaatcacttgcaccaaggagatggaggttgcagtgagccgagatcccgccactgcagtccagcctgggtgacagagtgagactcaaaacaaaacaaaacaaaacaaaaacaaaaaagatacacaaatatttcatcaccacaaacatctcccttgtgctactcctttagtgcatacacacctctccacaacatgcctggcaatattatgttttcatctctataatttgatcatttcaagaatattacataaatagaatcatacaatatatgacctttagagattgttttttcgtcactcagcataatgcctttgagatccatccaagttattgtgtatatcaatagtttgttcctctttattgttgaacagtattccatggcatggatgtaccacagtttgcttcaccattcagctgttgtagcacactttagttgttgaacattataaacaaagctgctatggacaatcatgtacaggtttttgtgtggacataagtttccatttctctagggtgaatgcctaggaatatgactggggtcctgttgtaaatgtatatttaattaattaagaaatggacatatcattttccagtgtgtttgtaccattttacattcccaccaacaatgtatgagagactcagcttctctgcatcctcaccaggatttggtgttgccactatcttttatttcagctgttctctgtgtagtaataacacatcatggtcttaatttgcatttccctaatggttagtaatgttgaacatctttttaagtgcttacttgccatctgtgttgtcttttgcccattttataattgaattgcttggtttttaatgttcagttctgagacatctttataaattctagatgagtcctttattaagtcatgcactgcataacatttcagtcaacaacagaccacatatacaatggtggtcccataaaattacaatggagctgaaaaattcctattgcctagtgatactgtagccatcataagattctagctattcatgtgtttgtggtgatactgatgtaaaaaaaacctactgtgctgccagacatagaaaagtacagcacacacaattatgtacagtgcatacctgataattacgataaatgttacagttaatgtatttattatattatactttatatcattattttataatgtattccttcgacttttttttttaattgactgtaaaacagcctcaagcaggtccttcaggaagcattccagaagaggacattgttacaggaaatgaccgctccatgagtgacaaaggcgcaaacacattcaatggaggaaggacagtcttcaacaaatagtggcaaaataagctgagcctaagctcatctttaaataaaaattaactcaaaatggatcagagatgtaaatgtaaaatataaactataaaactgtttagctaaaacacaggagaatactttcaggacatagggcgtggagaagaattcttagacacgacattgaaagcatgatccataaaaggaaaagactgacaaactggactttatcaaaattcaagacttttgctacacagaagacctgtgaagatgaaaaaataagttatgaactgagagacattacttgcaaaacaaatatagtcatgttgtaaagcatctttacgacgttgagtcttcaatatatgcaatgaggtatctctccattcatttaggtctcatttattgtctttaattagcactttatagttgtcaccatactaaatctggtatatattttgttagagttatacctaagtatacctttttgtggaattgtaagtggtatacattttaaactcagtatccatgtggtcattgccagtatatagaaatagcattgatttttgtaagcttatcttgtatcctgtgaccttgctgaactcctttattagttctaagattttttttttttttggtagatttcttaggcttttctctgtagacaaagatatcacctgcaaagatgtagtttatttcttcatctccagagtatgttttttatttccttgtcttgccttactaccctagctagaaattccagtactatattgaatagcagtggagaaaacggacatctatgctttgttcactgccttaggcagaaggcattcggtcttgcaccattaagtacaatgatagctccaggttttatgtagatactccatattgagtttaaagaagtttccttctattcatactttcctgagagattttatcatggataggcattacattttatcaaataatttttctgcatcaattgatataatcatgtgatttttctttcttagcctgtcaataaggtgaattaccttgattgatttctaaatactgaaccagctttatatccctacaatacacccttcttggtcatgttgtagtagaattctttcaaatagtgctggctttgatttggtaagatactgttaaggattttggtgtgggtggggggtggcctagattcatgagggatattgttctgtagctgtttgttttgtttttgtttttagtattatcttggtctagttttgatatcgggataaaactagcttcataaagtgagttagaattatttcctcttcttctattttctggaagaaattatatacagttgctattaattcttttttagacatttgctacaattcttcattgaaatcatttgggcctagagatgggggagagccaaattacaaattcaatttccttaaaaataatagagctattcaaattatccatttgatagtaagttgtggtagtttgtgcttttcaaaaaattggtccatctcatctcagtcatgaaattgatatgcgcagagttgttcagagtattattcccctagacgtttttggtatctgcatggtgacatcaacagtgacagcctccattttattttttatattaataatttgtatctttttttctatttgttagtcttgccagataaccgtctattttattgaacttttcaaagaactagctttttgtttcactgattttctctattgttttctgtttttaatttcattgatttctgttacctttatttcctttcttctgtttgccttgggtttattttgctcctcgtcttctagtttcttgatgtaggggctccaaactgttatttgaaattttcctcttttctttctttctttgtttttttgttttgttttgttttgctttttgtttttgtttttgtttttgttttttttttgagatgcaggatggagtacagtggtgcgatcttagctcaccacaacctccgcctcccgggttcaagccattctcctgcctcagcctcccaagtagctgggattacaggtgaccgccaccacacccagctaatttttgtattttgagtagagacgaggtttcaccatgttcgctaggctgatcttgaactcctgacctcatgatccacctggctcggcctcccaaaatgctgggattacaggcatgagccaccgtgctcggccaattttcctcttttctaatataagcatttagtgtcataaatttccctccaccagcctttttgaaccaacacagggttcacaggaacctaactgtatattcacattccttagcatcaggtcccgaaatttagagaataaaaaaccatattacaactggtttgaaatgagccaactcacaatgcctaaggcgcaactggggttcatttcaaaaaacaggatccttatctattttggtactatagacaagaaggaactcaatcttactaacaaaatatctaaataataagtaaataaatatcagtttgagcatttttctcagtctacctttccagttcctgctccagacctccactatatgaagagtattgactcaaatttttactgccatttctcaaacgtcaaaacagatgtcaatgctctgagttatggagccctttcctagagagcaagaagaaactgatcttctctcctgggtgtctaagagataacaaacaataccatctttttgtaacactaaaatttacaatccagttagggaggaggtgtaaaagattatttaatcaagtaaaggaattcacacctgttttctctttctttttcaatgttccatatcccctgaaattttataaatgtgtactttttttttttttttgacacggagtttcgctcttgttgcccaggctggagtgcaatggcgcaatctcgactcaccacaacctccgcctcccaggttcaagcgactctgctgcctcagccttcccgagtagctgggattataggcatgtgccaccacgctgggctaattttgtatttttagtagagacagggtttctccatgttggtcaggctggtcttgaactaccgacctcaggtgatccacccacctcggcctcccaaagtgcttggattacaagcatgagccactgcgcccagccataaatgtgtacttctaacataaaatttaatctggctgaaacaaatatttggaccatagtaaaatgcttctctataatttgttccttcctttcttttttctagcaagcttcagagccaacagggcgcttctcctggaaggtgaagtcatggtgacctactgctctttattcagtctgacatgtatgttaatcttctctacttactcttagactgtggaatatgatccttccaatgggagacagtggcttttctcttacacttttccctgtctcctcaccataaataaaatgaaaactgaaaaatgtctcccctaccaaaaaatctctgtcccttcttacacatccataatatgtagctcctacaatggtcttcaatgatccccacctcctggtattcataaccctgaatacttttctctccataaatgtagtactggcttattgactcaattctaataaaaagaattgatcaaaagtgatggatgtcacttctaagataatgttataaaaagattgtcttctgtcttaggtgatctctcattatctcctggatcctttttcctagaaggatccacatgccatattatgtggcagccctgtcaagaggtccacggaataagggagcaaggactgtcaaccaggagaatgatcctgggaggagattcccccaccatcccaggcaagttttcagatgagactgcagcccaactgacagtctgactgtatcttcataagaaacctgaagctcaggatcccaagttaagctgtgttcagttactgacccatagaaacaaggaaatgctcaatgtttgttgttttaagctaaaaacttgtggagtaaagtaaataaacgtcagtttgttacatagcactagataactaatgtaccttcccagctacagacttccacagccaagattaagacttatttacccaccagttaactcactcatttccaaagacccccagattctagaggaccccttcttcatttcgctctcctcatcaggttcctggtatagggaaataagtcatcaccatgacttaaacagtatggactgttttgttttgttttgacatcaaagcaaccaaaacagaatggaactaaaagaaagcaaggtttaaacttttagtccagtttcaactccagtctcagcaaagctctgagagaagagagttttatggtcaaaaatgtttggggctcttcccctaaatggcctgaggtgaaaatggttcaccattctcttgacccagaaacccccacaaaaagcatgcaaattgacaggttaaaattttcattttcactgcaagaacacctgtggaaccacccaggccatcgagggtatgcagatatgaaagccaccaagtatctaaaagatgtcacttgacagaagcaatgtgtgccattccaaagctacaacagtggagttggtaggtgtgtctgggccaaacagtggggctggacactgggtcggtggcccaaaaagagtgctaaatttttgctgcacatgtgtaaaaatgcagagagtcatgctgaacttaagagtttggatatagattctctggtcattgagcagatccgggtgaacaaagcacctaagatgtgctacaggacttgcagagctcacacggtcagattaactgatacacgagctctccctgccacatctagatgatcttgactgaaaaggtacaaattgttcctaaagcagaacagaaagttactcagaagaaaaggatatcccagaagaaactgaagaaacaaaaacgtatggcacaagaataaatttggcataaaataaatccaagtaaaacaattttaaatgtctcgagaacactacaagctatgtcctcttctcagagagccctgaagttttaacatattgaaagctctgatcttgccaaagaactccacttaacttcaaaacacaccctccacacacatcatgatcaactgagatcttactgaaccagaatcctaaatggcatacttcaggaacaggggtccagagaagcagttctcaaagtgcagcttaaaaagaaactgaaaacccaattcatgcaagacctagggcttattttagagcattttccagtgcagattggatccaatctaaacacatagaattaaattacgaaaaatgatacagactattacctaccaatcacccactaaaggacaccccagggatccctaactccactcttaaagtttaggaagacatcagcactctttgtggccatgcattaatttgctcaaccctttccttcatctgagtatttcctctgcccattgaaatccttgggcataggcggggcacggttgctcacactgtaatcccagcactttgggaggccgaggtgggagcatcaaaaggtcaggagttcgagacaagcctggccaatatggtgaaaccccgtctctattaaaaatacaaaacttagctgggtgtggtggtgcacgcctgtagtcccagctattcaggaaggtgaggcaggagaatcacttgaacccaggaggcggcggttgcagtgagctgagattgtgccactgcatttccagcctgggcaacagagggagactccatctcaaaaaaaaaaagagaagagaagagaagaaaaaagaaaagaaaagaaagcaatccttgggcacatagagtgtcgtggttaacatgatgggcccctggagtaacgctgaacttgctatctgaccatcacttactatacatgtcaactaatctcactaagtttcaccatctttatccaaaaatgagcataataataatatctaccacactggaatgcatgagataattctcgtttagctttggcacagtgtctggaacagagtaggcactcaaaaaatgccacctattgctacatttttcatcatccaatgcatcagatcttaaattaaccaattttagtttccagccgggtccaaacacctcaacatatttctaccacatcactcacaactgcaccaatttcatgtctttgctatgcctttgcactgccagactgaagaacttgatgtgttaagttcactcccatgtggcagctcttagctcttcctccccatctgttccagccacacctgtctcgaccttctctggttccaaatgacaacctgaattttagaagtttcacagtcttttacgaaaggtaagttttgctgttttgcttccagtatcattcaggatgccagccaatagtttgctggccttgtgatccgccagacaagttaacctgcaaagcctatcagattcttttgtccttttctggttcaaagatgaaaagcaggtagacagccgggctaaaaaagcttaaatctttcttttataaaatttgggaataaaagcctcaaaccagtagtaacaatgccacttgttacttggcaacaacacttcatttgccaaggtcagaagccatcgaaactgactttgtgcgtgggtagacatacacagagcaaaggaacagggaccaggcagctataaatccagcagccaccagcccctccaacagaaggcagtggctatgtgaaagtattattttcaagatcatcactagaatctatgaaaatgactcctaaagttggctagagtctgcctgaaaactagtcttattctaggatgcaagcccttatgtagtgcggtctcaagtgaatagcagctggaaagggaaacttcaccccaaactctgcaaaattgcaaatcaagggcaaagttgagacaatggatgcaggtttggcctttgagtgaccttagtaagttacttagctactctaaccacacttcatttgtaaaacaggggtcatgatctagatcttccagagtgttatagttaaatgatgctctgccaccagagtcataatagggccccacaaaggtccttatagtaagtctgagtagcaactgcctcaaagtaccagcagtcatgatcaccaatatgttttgagcacacactctgtaaaaatatgtgctttcgccttgtaacagttctgaagcaggttctgttattattgccaccacagatggcattaactgaaggtctgagaggtaaagtaacttacccaaggcaggtaggaaatggtacagctagaactcagatccaggcagtctaattccagggcctatggtcttagccattataccacattgcctctgtgaggaagcattaaatacatatttgaaaggatggatgggttgacaaatataattatctggtgctttcatcctctggggtcctactcccccaaacaaaggaaagaaacattgacttgtcctttcagattacaaagaatagcaatgtcttacaaaaaaaaaaaaaaaaaaaaccctaagcacatttgtttataccaattttaggacaattatttcctaaaccaaatttttactaccctgaagttcggtacttatgaaaacactgccaacataatgaaatgactgtgcaaaaagcaacagctgatcactagaggcaattttctttcttataaatacaaaaatcctatcagctaaaagaatgtagcatgacaaatcacaaatcagagacagagtcttctacatgaggatttaaagctcaagaatttcaatgtacttaataacataaaatctgaggcagatggctcaatgctttagaattcccaaattgttaagggtatcctggatggaaataccctagctaggtttctatttcttttctggccggcaccacctggtggttttttttcctctaaaatctaagtccacacaggccataaaattaagatctggacagcattcttgttgtcaaagtgatccacggaagaaatctttaatttcatattcatataattctaactaacatattaaacaaattttatttttatccatatggagatagtctcatctctagtgcattttcttaaatatatttatcaatgtgtatgataaatatcaaaatacatgaatttaaaatcccgagagtactcttgagcttacacatcatggggaacaaccaacacatcattcaactatcattcattcatcctctcaatcgtttatttattcttttatgctaaggatgcagagatgattttgtataagttaaatgtgcttttgatgatgaaattccactgggtactacgctcttcactattttacaagtgaggacactgaagctcagcctaactaaggaatttgtctcacgtcacagaaatagcagagctgggatttaaatgtagttttggaaccaagcatggtggctcacacctgtagtcccggcaacttgagagactggggttggggtataccttgagtccaggagtttgagtccagtttgggcaacacagtgagacttcaacattttggttgatcttggatagctcagaagtgatcaatacccttccccgatagaagaacaaaggagacaaccagagaataagagttacccaaaggacaggaaattcatttccccaatttattgccagaattaaaaagaagaagtcagaagcattccactttgtcagaccacgtgtctctgtttggtttactggaagaatggtgaacatggggaactgcatgttatcctaaatgaaacttcatataaaagaaaaccaaatgagaaacatatggaagaattaaagtggcgagctaagtgaagcaaagcgaagcaacttagaatgtttcgtatcctacgctggttctgagcaggcttaataagaagctgacatcgatatctgatggcctgagaatctacttcagcactgaagtacacttactcctggccccatggacctattattgttcaacttgcaataatgggacacttccaaagagctgacaggcaatctttaattaaaatacactgaaaataacttgaggcacagtttgcacaaagaaaacaactgctctcttaagttacccaacataagttgtattcttttttttttttttattttctttctaagctgagagttttcactgaagggaagaaactgattttacaattaattaagagatgaaaaacctatagcttagcagttaaacacctgggtcctagacccagataggcctgagtttgagcccagtcacctgcaagctgaatgttcttgatcgttatttaaactctcttagcctcaggtcccccatcttcaagtggagaagacttcctgccatagtacacaccacagcagatcaccaaatgtttccagctctctgctgctgtggacacttcctggcttactgatttgtgagtgagtggggccatgtgattggttctagccagtgagttgtatgcaaaatgaagcaaatcacttgcactccaaacacttaactggcagctcaagactattcagagcattctttttttttttttttttttttttttttttttttttttttgagatggagttttgctctttttgcccaagctggagtgaagtggcgcaatctcggctcactggaatctccatccccagggttcaagtgactctcctgcctcagcctcccgagtagctgggattacaggcatgtgccaccacgcctgactaagtttttgtatttttagtagagacggggtttcgccatgttggccaggctagttttgaactcctgacctcaggtgatccacccgcctcagtctcccaaagtgctaggattacaagcatgagtcactgcacctgacccagaccattcttttcccttctgcacaaacaccagcaatgttgggtagcctctttgtcagtctgaatgacagtgatgagcacagtccatctccctaccattgacctatttgctgcacaagtatcctaagctaaaagtaaactttcatatatatatatatatatcatcaaatatacatatatatatatcatcaaatatacatatatatcatcaaatatacatatatacacatatatatatctcactgggatttgagggttgctggtctgttattgttagatgtctaatactgactgataaactacttcataagctggttgtaacaactaaatgaaataaagaataaagcctggtaagatgtctgtaagtgcttaataaatgacattttgttgctgctgttaagaaacaagtatttcttctacacaatggttagactgtgtatttttcatcacatctaacgaaggaagaacattaactgagctaaaatactttctccttcctttttccaggttccactaaagatttgatgtcagtgtttgggaatctacagaaatttaaccccaaagaaaccagctctccctctctagattcaactttaaactgcacaatttctctgaaatgcagataaattagtcactttactaatttggttcaaagcaagaatatgtatctgaaattaatttatcaattatgtactatatcatttatatactattatgatctagggtcataccctatatttttttctaaatcactgatattagaagtgaaataaaacattaccagccaaacttgtttgaataccctatttctttatatatataaaaaaatagtgctaatttaaatgtatgttacagaacatactaagagtttgaacccatgtgtttgtgtcatgctgtaaattatggtaaatgcagtccccttcttttgcagtatacaaactagaatgaccaactgtcacaatttgcctaagtcttgaccacttttagtatggaaaaacctggaaaccatatgcaaacttaatcccagtttgcccggcgctttctgggttttaaaactgaaagtcttgcatcccaggaacactctcaatccagggtaaaccaggatggctagtcatcctaatgcaaagatatccttgaagtgtcaagataagcaagacacctcttcctggaatgtaaagatacaagggaggaacattacatcatctaaaagagttttccattaaaacaaagatatataatagaatacgatataaactctggatgaacttttagaatagaactcaagctgtcaaagtaatgttgggctttttgtcctctgtttttacaggggcacactggagaaaaagaccaataagcagtgctttagaagaaaagccaccgacacagaaacaaccaggatgcaacgttcactccctcccttactttctccacggctgagaacagtcattaaccttgctctaggccccagtcaggctacctttattttaaaaatatgcctcaagcacggcgtggtggctcacacctgtaattccagcactttgggaggccgaggcgggcggatcacctgaggtcaggagttcgagaccagcctggccaacatggtgaaaccctgtctctacttaaaatacaaaaattagccaggcagggtggcaggtgcctgtaatcctagctactcaggaggctgaagcaggagaattgcttcaaccggggaggcagaagttgcagtgagccgagatcacgccactgcacttcagctgggggacaagagcgagacttcatctggagaaaaaaaaaatgcctcattagaaggcagggacttagctttgttcactgctgtatgcctggtacctagaactatgcctggagtttgactaaatgagtaattaaatctctcagccagggataaaactaatatccacatcaggattgttgacgctatcaaagaagatcatatacataaaagtgctctgcatattaacaagaactgtacaaaagtgactattatcttgcagatctcttgattaccttattttctcccacacaatgacttatgagtattacattgttgccttatttggattttgatgggcactggtgatggagtgtaagcttgcaaactaaataaaaaaaaatctgttaggttgccaggcgcggtggctcacgcctctaatcctagcactttgggaggccgaggtgggcggatcacttgaggtcaggagtttcagaccagcccagctaaaatggcaaaacctcatctctactaaaaatacaaaaattagccaggcgtggtggcatacacctgtcatcccagctactcaggaggctgaggtaggagaatcgcttgaacccaggaggtagaggctgcagtgagccgagatggtgccactgcactccagcctgggcaacagagcaagtctctgtctcaaaaaaaaaatgtgttaggctaacatgtacatacacatacaagatggccacatatgtttggaaatattttcaaaaatatacaggcagaagtcgaatgtttatgttcagtaatataaaaaagtttaatcaaagaagttttagaacatatgcatcataaggaggaagatattgcatagttttgatctgcgaaagaggcaagaacgggggaagaatttgagaggaatgtggataaaggccaaaagttgaatcatatggggaaggtttttaagtaggaataaaagcgaatacattgagctggaagtgggaaggctcaaggaattgtgggcccaaggcaaacttgtcaaaccaggaagatatctggtagggctgtaaacagcctaaataccaagcaagttcatgcatcatcactacctatatctgtcctccttggtggccctatcataaggaagaaatccttgccaaggttatcctgctggtgtcttccacaaggtaacaaggtagctggcgatggaagtagcattgctgtctaggatgggctctctgcacctggccagcatcagttttgagcctccccagaaaggaagaggagggtagtgagcaaacatatcttgcttgttactattgctctcacgttgtgtttcagatggtggaacaacatgtaaaactctacccagtaggtaaacactagacagacgtgcgtatatacacacacctccattaccataaaaatgtttgaagacacacttgacaccaattttttttttttttttttgagacagagtttcactcttattgcccaggctggagcacaactgcatgatctcagctcaccgcaacctctgcctcccgggttcaagtgattgtcctgcctcaacctcccaagtagctgggattgcagccatgcaccaccacgcctggctaattttgtatttttagtagagacagggtttctccacattggtcaggctggtctcgaactcccgacctcaggtgatctgcccgcctaggcctcccaaagtacttggattacaggcgtgagccactgcacctggccaacaacaaattttaagcaatcggcaaagtatcagaaaatatttgtggttttggctgggcgccatggctcacacctgtaatcccagcactttcggaagccgaggtgggcagatcatgaggtcaggagatcgagaccatcctggctaacacggtgaaaccccgtatctactaaaaatacaaaaaaaaaaaaaaaaaaaattagccgggcatggtggcacgtgcctgtagtcccaactactcgggaggctgaggcagggaaatcgcttgaacccaggaggtggaggttccctccgggaaccaagtgcattgagccgagatttgtgccactgcactccagccagggcgacagagcgagactccgtctcaagaaaaaaaaaaaaattaattgtggtttctactctgggacacatcagcagcatctttgttaattcataactcaagatttaaaaataagtcttcagattaatgatagcccaacccaacatgatgtggtaaacagctcaactgaaaccataaacatcaccttgcttgtgtgatataaatagttctataagtacatgtttaatgcattgataggtaaattcctagtagggcaaagataagatcttaattcattcacctatgcatactttgtgctgacgaaatttttaacacgagttccatccctcaaatgtttcaatatcaaaagtctaaaatgcataccatgcttttaccagctgctgggaagttggaatgtatcaaaacgtattcatttctcagttctgcccacactaacctccccattaacttaatattagggagacaagcaatgaatttctggatcagtaagtaaaacctgagacgtatccaaaaaagggcagctgaatgcaaggaaacaaaagcagtctctatcctcacaagaccatattttattaaatgatttcaaaatgcttctctctgtttgatgcattttgctgctgatactcaatatggaagccttccagggagaaagtggttatctcaatcaagaagtgccccgacaggccaggtgtggtggctcacatctataatcccagcactttgggaggccaaggctggtggatcacctgaggttgggagttggagactagcctggccaacatggtgaaacttcatccccactaaaaatacaaaaaaaattagccgggtgttgtggtgcacacctgtagccccagctactcagcaggctgaagcaggagaatcacttgaaccagggaggtggaggttgcagtgagccaagatcatgccattgcactccagcctgggcaacagagcgagactctgtctcaaaaaaaaaagttgccctgacaaaaacaggttagctgtgtaaaaattctaatcttttatttaaaggtttaaaaaaaaaaaaaaaagcatcggctactcaggaggctgagatgggaggatcccttgaggccaggcgtttcagaagagtctgggcaacaaagtgagaccctgtttcaaatttaagacaaaacacaacaaagaagtagcagaaagaaacaaggagacatgagtacatgcaatacactttctccttttcactcaaggattttgctgtcccagtaaatgtgacagtgctttgtacatacaactttgaaagaataggtgcatgaggcaataatgtgcctccatctctccatgaaaatcctgagttctcctcaaaagctcagaaattcccatgccagcgtcttcacaaccaccatttccatgtgattaaaataaacagccaccttttctgaaaaatggataactttgcaatatgttcatggaaaagctcaatgctgttcttacaaatactactcaaggaagttttgtttggaagaatttgaataaaatgtcccacgagagggttctgcaaatgaggcacaaacctaaaaacacagctagtctctgtcacctaaatgagctgctgtggcctggctcatctggtagcaccatgactcgcagttcctgcaaacctcccagggtgcaaagccatgacagatggtcacactactgaaaggggaatacctacaaccacaaccaaagggagaagtccacagaagtccacaaccaaagggagaagtatgacaccttggaaacgtaaacagcatcccctaatcaagggctgcaaagtcaaacgtctacagggacaaggaaggtaatataaataactacgtacaacatctgctgggtattatgcaagaggggatggatggtgctggctgcagctgcagagggtgtgccacacctgaagcataaaaattattatttaaactctgggctgataaaaacctgcccaaatccgtggggggcgggggtgagtttacagcctgaagcacttagcaccctaaccagcagacaggatgtgctcattaaaagatgccattataagcaggaagccttgtgagtccacaagagaaaaaaaggcctgtgaaatgtttgctttgagatccgcagaaagagataaacagtaccaaagaaatgggaggaaagggcttggtgcgatggctcacacctgtaatcccaacactttgggagacaaggcaggagaattgattgaggccaggagtctgagaccagcctgggcaagctaagacccccatctctacaaataaaataaagtaactttaaaaataaaataaaataaaatggcccagcatagtggcttgcaccagtaatcctaactactcagagactgaggcaggggggatcacttaagccccagagttataggctgcagtgagcaatgatgagaccactgcatccctgcctgggcaacagagtaagaccttggaggagacgggagatggggaggagagaggggaggggaagggagaaacagagagagagaaaggaaaaaaagagaaaagaaaggaaaagaaaagaaaacataattaaataaaatcagaaagtaggagatagcacatgtagatttgtaagaaccaacaccggatagcccattaacccccatagatacattggctctggtggggaaaagcaccatgccaattcaagcaaatgtgaaatgaagcccttcattcatgtgtatccactcactcattctttccctcacttacgcaacagctagtcactggaagcttctcgcatgccaggcacccctggctctggcctgaggacatggtgttagaccaacacaggactcttccagagcttactgtgtccagcactgaccagcagaattttcttgatgatggatgtattttagatctgctttgccctatatgattgctacatgtgtctactgagcatttgaaatatgactatggcaactgagggactgggtgggaggagtattttattatgtttaattttaactaacttatatttcgatttaaatagtcacatatggctaatggctaccatagtggatagtaaaggtctaggtagggtgtccaggcatcgccctcgggttggggagaagaaaaagcaaaagggaatagaagactccagaagagtagaatgcaggttttacctccctgtatactcataactttctctataccaatcaaatgcacagcttatccattcctgcctcccacaaccctgtaacataccctcccagatggcagaagttaaaaatgaatggcagatggtgacactcaatgtcctactcaataaagtgtgaccagagcaagactcgatgaactcaggtatctgatccaatttgacccaaactgcaatgctgcccaatgctgtgttctttcctcacagccctgcctggagaaggtcatcgggtgacacagatgctgcatgactatagaaaacaatgattctaagacaacacgccaggctttcctcccctccattctgacatatctcagatgaacaagtaaggacatcatcacgtgctacacctcaatgtcaatggcactttttcaagaggtcagtgtgtcccctccatactgatgcctgggacactgaagttgggagctgatggtcttaaccctctctgcaaaactacaacggtctcttggctccagccagccgcacaaactaacaggaccttgcctctccatgggagtttctgggcatgctcaagttcatgagacgcctaacggaaggggaactcaaatcgcccatggatccagacttccttttctcttaatccagtgacatattagaaactgtcaactaacctaccagaaacacaggaatcacatgaaaaccaatacaccctgacggccctgtttacttgacaggagttggccagctccaacagaggtaatggggcttattggggctcatggccactgcacacgcacaggctacacctggcagaaaggcagcccttctttctcaatagcagttggcctttgttcttaaggtcagttgccagagtcatggtcagaagcatttagaacaggaaacagagctaatctttacaaggactggcaagtagtttcctggagaaaagaaacatgagagagtacagcacaaaaatctagtactggttcagattttatgaaccatcaaaacacagaaatgctaccaagtaatgctgcagagatgtcctattcttcacatttgaagaagttaaaaattgataaacttttgttcattatcaccctatgattgtttgcaaatcagaagactttcttagctattctctaatttacaactgctaatctttgcattactccagccagggcagctatcatcagccccaaatcacacagaagaaaacaagagcagagggtcctgctgggtcacacggttcagggtccagagctaatcgctcaggctgccttggtagagatatttgccataccatatcgtagaaagctggtcagcaaagctgtgatttttagctcttccaagtatattgccccttggaagaccttataaaggtttataaactttagatgctgtctttggtgaaatttttaaaactgctatgtactaggaagctagtcaggtggtgctgtagtctgccacccacatagatgggacagacacagaagggcctgctttacctgtgtgacattcgtttcgtggggacacagtgaaaacatcccttagacatttaaaaagaggtaggaaggcaagaagggggggaacaaatgggtctaatcacacaacatttaggtgattaggcagggattcatgaaaacctagtgttttaaatagtattcattctagcctggtatggtgcttgtgcctatagtcccagctattccagaggctgaggtgggaggattgcttgagcccaggaggttgaggctgcagtgagccaacattgtgccactgcactccagcctgggtgacagagagacacattgtctcaaaaacaaacaaacaaacaaaaataatattaattctaaaatgatgttaacaaatataatattttaataatggcctaagcataaatgccatccttagcatcaaacaaaactcatgaccagcagaactttccagaagacttctgctccatgttgacataatatggtaagttgacaaagaactcactgctccatgttgacataatacgaagtgatgttgtgatttataaacataatgattaggaaaaggagctcagcctaccatctatgacacaagccagttgtggagacaacacatcaatgggtctctgctgcattcaactaattttttcatcttatagatctgtgactctgattggctgggtaatgctattaataaattggtaaaagataagaaccaagattttcaaagttcaaataaagaataactaaataattgcttcttcccagaaggaaatgaagattcttttccttttaaatctgttgtactctttatctcatcacaggatctaattatgaatatctatctttggagaagaggaaaggaggaggaagatagccttgtgaccagaaatctttgctttttaaaaccaccaatgacctggtctaattatctctgcaaaaaactcatctgtgatgacatggggtgaaaccacagtgcaattttcaagaaacattttatgcaaatatatctgctccaactgcatataaattaaaatagtaataaatcaaatcctattttctgattggcttgtattattatttcagttaattcctcttcctttctgaatgagctaacaccacgtttctctgtatccaccataagtataattggagctgtcaaacttaaagagcaagaaagggagggatgagaagaaggaatcatgtacacgttggcctgctgtgtgccagatattgtgctatgtgctttaaaaatgctaaaactggctaggcatggtggcttacgcttgtaatcccagcactgtgggaggctgaggtgtgcagatcacttgcggtcaggagttcgagacccgcttggccaacatggtgaaatcctgtctctactaaaaatacaaaaactagctgggcatggtggcgcatgcctgtaatcccagctactcaggtggctgaggtggaagaatcacttgaacccaggaggtacctgggtgacaaagtgagactccgtctacaaaaaaaaaagagctaaactttatgggaggccattgttttagctaagcacctgcattagacccctacaaatcagaaaaaactgaaactccatttagcatggagtcactcatgctaaatgccacataagcaacttaaaactttaaggaagcagggctgggcatggtggctcatgcctgtaatcccagcgctttaggaagctgaggtgggtggatcacctgaggccaggagtttgagaccagcctggccaatgcagtgaaaccccgcctctattaaaaatacaaaaaatacaaaaattagccaggtgaggtggcactactcaggaggctgaggcaggagaatcactcgaacctgggaggcagaggttgcagtgagctgagatcatgccactgcacgccagcctgggtgacagagcaagactccatctcaaaaaaacaaaaaaaaaaaactttaaggaagcagatagatcccccaaacagaccaggttttcttgaaaacaggagattccagtctacctgagtcagcaaaataagtaggtcccctctgctttaacccttaccaaaaagtaacctatgctaaccaatcaggtgtttttttgtttgtttttgtttttgtttttttttttttgagacacaattttgctattgttgcccagggcaatggcgcgatctcggctcactgcaacctctgcctccggggttcaagcgattctcctgcctcagcctcccgagtagctgggattacaggcacgcaccaccatgcctggctaattttgtattttttagtagagacagggtttcttcatgttggtcagactggtgtcgaactccccacctcaggtgatccacctgcctaggcctcccaaagtgttgggattacaggtgtcagccaccgcatccagcctaatcaggtattttttctattcttctatttccccattcccacctaacaaaactcactgttctactactgcccagagggagcccttattctatttcgaaggaggctgctcagatttatgaatcgcaaataaaagccaattagatctataactaagtttactgtaattttgtcttttgacaaatatgtgattgtatttaatccttatatcagaactgcagacaagggtattgacagagccatctttacagatagagacacggaggcagagttgatcaggggcatgtcagaagccaccgatccgggcagcccgcgcgttcccctccctccgcaccgattaaaaagaggaacaggtcctcggagtgtgctgcagggatctctaacaggagccatggggatctgccatggtaatggcatgctcagccaggtgccagagaaaggtcccctaggatggtgtcaagagtctgtcctccccgtggcagccagtgctgctgaacagattccatgggggagaaaggcaggatgcgtgcggtaggttcacggtgaggaatattccctcttccatttccccagcttctctgagaaggcagattgtccttcagagatttcagccaggtccaacacgacaaatacatttgtcaagccatttcaaagtaacaaacaataatcattattttacccattacttctagggtaacatagagaattcgaattcaaattcaaattcaaataccatttcaaagtaacaaacaataatcattattttacccattacttctagggtaacagagaattcaaataagaagggcataggttgttctttaaggaaggttcttattttcagcagcatctccatggatgtgagagggacagccaaagcacagccacaacgcggcctttgatcatggggccagggacacactcaaaaggatgagtgacagaaagcaagcccccctcgctctagttttccagctgcagggaggcaaggagccgtattccttaacagaagtcacaaagtggaaacgtggaggctgaagaaggctgttgcaaatatttgacgtgccaacaaaatgtttgtttgatttttaattaagttttgaatttcttataccaggtgagtactctctggtccagtcaccaccccacccaaagtttctgaccctctcagccaggccagtgtcactcttgagttaccctcttgactctaaagacttggagtttgcaatccctgttttatatagtcatggggagaaaagaactaaaccccttatctgcagaaaaagtattacccctcttactaacacctcttgtatataaaccactgaaactgggtatgttagtactgtaatagggaaaatagactccagaagagattattataaataaagatgggtaacagtgcagcatgaacagagaagagggaaatccatctctgtccaaggaggcaatgaaaagtttcagagtgaggagccacttgacctcagtcataatggtgagtgggagcttgcagagggaaggggcgccgtgaaaaaaaagacactcgtacaatgaagagcagagtgactcaatggctgaatcacagggactgggccttcattgtcccgtctaaaatgtggatctaacttttcttgaaaaaccaacacagagcagccaacaaaaacccttataaagcaacttgttgagatattagcaggcatgtgcagtccacagtgctaaatcacgtcacgcatcataagatggcagatctggaacaaccggtaagacctcttgcacaaaaagtcacaaagaccatgccctgtctctctaattggcaccaccaggctcccagaactgacatcttatttatcttcaattcttctctttgcactatgtctaatgaggctctgtccacctcatgtaagacatggttcttttgtttaccttctcttctttatgaatacccagaaaggtaacattgcctagcaagaggcattcattagaggttaagagctcacgcgctggactaagactagccagggtctgaaaatcctggttcttctctcagcaagctaccccataagctcagttttttcttctataaaatggggaaagagcagtacctattctcatatggttgatgtgtattaagtatttaacagcacctgccacagagttcatactcaataaatgttagacttcattaatctaattactcatgccttccccatgagccctcttccctttctgtctctgtgtttctctcctctagatcattctcaacaccagcatcatcacaattaatttgccataaacagcagcacagcaggatctaccactctgttcctcttcaccctgcatcacacacctagtttctattccacagcctcacatgtaacgtggtgggaccatgtaactgggttctatagctaacagaaatgtgaactcaagtgacatgagaccatttcaggcttggcttataaaaaacttcatgacagtccatgttctctcctcttccaccagctcatcacaagtgtgcatagtggcatggaaaccacatgctgcagatggcagagccacaaaatgcagagcctagagccctgaatcaccacttagaagagagtcacctgctaattagaaacacctcttttggaaattttgtgaagaaagtatagatttctcacagattaagtcacagaggttctggagtttctctgttatggcagctaacattacctttctccattcttaaacatttggtatgttcccactatctacagaatgaaacctgacctccctagcatggcattcaaggtctcccctaatccaggcccagctactctccaagcccctttctcaccatgaagccagtaatgtacctagtactttccataagtaccaggcattaataaaccttcccaatcctcaaaatctttgctctcagagttccttctatcagaaaggaccaaattccttaatagttgacaaaattcggatcaatcttcaaggaacagttcaaataccatctcctctgaggagctcatgtgatactggttaccatgtcttctggctaccagaatagacagaacagactatgctcactcctttactacaagactattacttatgatatatagccaagtgtctctctgtgttttcacactactgaggacttctggagagagaggctaagagcctttcaatttcatattcttaatccttaacacactagctggaatgagtaggaacttggtatgttgtatagggtaaatttaaaatcataaagaaataagggcacattccacgtatcattaagtagtatgcccagaaatgactacttggcctcaaatatcataaaagtgagaccacttccttgatgtaagttctttgcaggtcaattacctttgttgacagccctggttgagatatacaaatgtgggtcactggacataagaaagacaaatgagaacgttggcaaattcagacagatccactctactgctagactaagagttcaaagcctctaatccatccatcaaaatggataaaatagatgaaaaatcagcaataatctaaacgcaacccaaaatgacttgatacataaattatggcatatccataaattaaatattatacatctataaaaatcgacatagtcccctcttttcctaccccaattctacctccacatgctagtcttcagattctagctgaagtgtcatttccttagaaactggtcccctctgttaggcactcccagagtaactttccctcagagctccttcacattgatttggtataattaattgattattgtcttgctctctaactactactaaataaatgagagtggaaagaatatttctcttttttatttgtaaatagggtgagtgaatgaataaacattcaacagaatatgaaacaaaatgaaaaaaacgtaaaccaaaaaaaataaggttatataatagcatgtatagcatgatcctattttgtaaaaaggttatacccatctgtcaacctaaatacatacacagacacacacagacatagagaaacgtataaataaataacctgtataacctaaattttggaagattcttcaccaaaagctcaacactggatttttctagccaaggttgaaaggatctatgtggagtgatcatgacctcattcaggctcttctttctccctggtacaggccagggttaatttcctactaagtgatggatgaaatagctttcctaaacatgtggaggaagtggcctgctttcttgctttgctcaccaactacaaaaatggcagctgtgatggggaagcctggactgtcaaggccacccgtcagcgagacggcagactccatgtcacgtgccacacagctacactggccacatccagccctgcacagctgcatagcagaatcaggaaaaacagtacttttcattctggtttcccagattgaaccaggttactacagagaggagaaggtgaagaatggagtggggaacaagactctgcctccgtaactctgccacctgcctccaggctgtgggaggaacaccaggtggctcttcatggccattcgacagaaatattagactaatatggaagtcctgcctactcaacctgccactgtccaaatctaaactacagtcacaaaatgaagattctactgaggctacaaatattgggaaaatcaatatttttaaaggctggcagggataaagaaagatatgcaaatggtcatcattatcaaaatgataagacactaagcagcactcctcttcaatactgtagatatacacacctgtaattatgccatccacacacctacgtacatacagagagggttgatataacactcggatagacactaagcagcactcctcttcaatattgtagatatgtacatctgtaactatgccatacacacaactacatagacacacctacagagagggtctatataacatacgataatgtttactaaaaaaccagaaggaaaccaagtcagcataaactcacattctctgccctttgatggtataattttctcctagatttttaccaaataaatagtctaggatgtgagccaatataaaaaatcagaaaaatcctaaacggcacctgttaaacttcaaaaaaaaagcactgaccacgtgcagtggctcacacctgtaatcccagcacttagggaggacgaggcaatcgcttgagctgaagagatcaagacctgcctaggcaacatggtgagacatcatctctacaaacaatacaaaaattagccaggcgtggtggcacacacctgtactcccagctacttgggagactgagatgggaggatcacttgagcctggaggcagaggttgcactgagccaagatcacaccactgcaatccaggcctgggtgacagagtgagatcctgtctcaaaaaataaaaataaaaaataagcactttgcaagtgtttttttgttttgttttgttttgtttgcgatggagtttcactcttgttgcccaggctggagtgcaatggcgcaatctcggctcactgcaacctccacctcccaggttcaaacgattctcctgcctcagcctccagagtacctgggatcaccggcattcgccactacacccagctaattctgtatttttagtagagacacggtttcaccatgttggccaggctggtctcgaactcctgacctcaggtgatccacccacctcagcctcccaaagtgctgggattacaggcatgagccaccatgccaggccatactttgcaagcttttaaaaccacaatggcagcagctgacatggaatgatgttcataacatatgactgagagaaaaataggtttcaaaacattatgcactgttttgattcaatttttgtaatgtaaacatataatttacaattattaagtaaacatgcaatatataaatacattaaatatataaatataaaacatgtaaattatataaaatatatactacgtataaagaataactgtggctgggggaattgttggtatttgctgttttcaatttttttcttttttttttaacagacagagtcttgttttgttgctccagttggagtacagtggtgtgatcatggctcactgcatcctcaacctcctgggctcaagcggtcctcccacctcaacctcctgagtgcctacttctttttttttttttttaatgcaatgtgcatttaagaggggaaaaaaagcagtaacagaaaaaggaaacactaaaagaaaaaggaaaagaaaatcctaggctgggattcagaaaagcaggttgatctaagatctcagtaggccttgaacgactattcataatccctcccacccaaccgctacctgctcccaccagcacagaaagaccaggcaatgacagactaacctgtataacctgaactttggaacaaaagaactaaagagatgcagcatctcatttatatatatacatagggctgacatatgaattccactgtgggtactgcctactaaacctttcttacattctctgtcacctcccctcatcccagaggtctaaacttctgtcttctaagtttgattgtttcctaaggcactgccatgttcatcaaatcagctaggaaaaaagaacaaacaaacaaacataacttgtggtcccttaccaagagcaaaagaagtcagctactcggtgtaaacagggaagaagggaggcatcacacaagagtggatggtggagactgtggtcaatcagctggactgctgctggctgtcccggacaggatgtgaactcagcaacatccacctagcttcagatctttttaaagagaagctgaagacctagatgtctgggaaatctctctatttttcaagggtccatgagcatgcccttggggtgagttgcttagtttcctgatctggaaattggagaccattaagaacatgtctctcacaaggttgttgtgaagtttcaatgagttaatctatccagaatacctagaaagttaccaggcccagagtaagcatttggcactcatcatcttccaaccaccagcatccactggccaccagtttgcaacccctgggctgctactacctgagggccagggggtccctgagggacgaagatatgctatcgtcatttgtccaattcctggcacgctgttggcagcagcattttctgaacacatcaatcaactgtagaacaattcctaaaaagttaagctccacaacgcttttctggcatcatcaacccagttcccctaacttcaaagggtgtgagtgggaggccaggcatggtggctcacgcctgtaatcctagcactgtgggcggccgaagtgaaaagactgcttgaacctaggagttcgagactagcctaggcaacatatggagaccctgattctaccaaataattaaaaattagccaggtatagtggcccacgcctaaagtcccagttactgtgggggcgagaggaggtggtggtgctgaggtgggagaattacatgagcctagaagtgcaaggctgcagtgagccatgatctcaccactgcactccagccttagcaacagagcgagaccctgaatcaaaaaaggggtgggagtgggggtatgagtgggctgtacaacaagcacagtaagacagctccacaccctagcccccaagaagccctgccatttactgtgctttctgaattccactctgcactggagactcagggtccaggagtctgaggaggcgtcaggtctgaggaggatgggaacagatggcagtcccaaaagtgcctccttgtaaccactgatctatcaggaatccataagctgctcctccctgccctgtcatttgcttacaagtctgcctgctgagaaaaatccccatgaattcttagggtccatatgctgttctggaaagttggccctgtttcaggtagagaaagaaagacgctccagtgctttcctaccacagcctctcctctggcctaggttccagttacctttaagaaactaactgttatcacagccaccttgccagtgaggtttaccttgaggcaaaacctcaaatgatcctgcaaactgaggatggatgacagtgatcaccactgcacagtaaatactcaacatgtgtgagaccccaaactaaatgctctcagcaatccttacatcaacctttgggctaagtatgaatattcccatttcacagaggaggaaaacaaatctcaaagacgtgacacaacacaccaaatgttgacgggtagagcgcagattcaaaatgctgtttgactctgaacagagggcctgtcatgaattcaccacataaccttctagacagactccctgcaccctggaaaaatgccttagtgtctcattgtatcagttatggggtatcacaaatgcactcagcatatatctttgggagaatgcttacccacatccagtctttcctgctcttaatgccaatggaaatctgtcggcattattcccttgagcacctaattatatgttgggagctaactaatctccctcaaaaaaccacaggccattacagggcaagggtgacaagaaccattcctacatgacccagctcagcaaagacttgttaaatgagttcttaaacaattgtagctagattctaagacaaactagcttttttcaatactttgcatatttttctgaattcttgacttctcgacaaagtccaccctgatcaccccatgtaatactaccacctgctacctgcctggacattttcaaccctctgaccctgccctactttttcctttgcccatagcccctatcaacttctaacatacctcataattactgccgggcgcggtggctcacgcttgtaatcccagcactttgggaggccgaggcgggcggatcacgaggtcaggagatcgagaccacggcgaaaccctgtctctactaaaaatacaaaaaattagcagggcgtggtggcaggcgcctgtagtcccagctactcggagaggcagaggcaggagaatggcgtgaacccaggaggcggagcttgcagtgagccgagatcgcgccactgcactccagcctgggtgacagagcgagactccgtctcaaaaaaaaaaaaaaaacaacaactaattgattatgtttataatgtgtcatctatcctaccctacctgccatccccactagaatgtacagatcccaaaggcaagactggttttttgttgttgttgttgttgttgttgttgttgttgttgttgttgttgttgtttgagacagagtcttgctctctcacccaggttggagtgcagtggcgtgatctccactcactgcaagctccaccccccaggttcacaccattctcctgcctcagcctcccgagtagctgggactacaggcacccgccaccacacccggctaattttttgtatttttagtagagacagggtttcactgtgttagccaggatggtctcgatctcctgactttgtgatccgcccacctcggcctcccaaagtgctggaattacaggagtgagccaccgcgcccagccaagactgttttttaactgatgtattccaagggcctacaacagagcatggcacatagtaggtactccataaatatttctaatccaactgaaatgaaatgaggatcctggccgcttggtgtctcacattcctcacctgcaattaagcggttgtagtgctgcttatttcatgagaatgagaaggcaagagacacatgtgcagcacgtggcccagtgctggcacgcagtaagcgttcagtgcatctctcctattctttaccctagaaatcgaaatctgcattgcattctgtacctggcttcatagctcaggccattgattactaccctcaagttgtttctgaatctgggagagccattcttcattaaatgcatttcctcttagaaagagcgatttgttctacacggatgctgagcatttatttctatcatagacaggagcctataatgttgacaaatgtgcgtaatgatcagtaaacaaacacaggaagggcagggactgaacttaatttaataggctgcctgagcactgagatactttttttttttttaattcccaggatccaacgtcaattcaatactggaagcctgggcctccaacaacccttcagtttcattcattaagtgaaagagaaagactgtccaaatgatagggaaagcctgtgtagcaatgagctattcacattctgatctccccatgcaccctgatctcttctctaggacctagagggcaagggtgtgtcttaatgcatctttctatctatcccctggccccggctccatgaatggaccaaggcagtgactcactaaaatgagaaagagagcagggaaggaggggaagaagacagggaggcagaaaggaagacagtaagagagtcaaatcaagtagagaaggagggagggagaggagaagggaaggaagacagagaaagacaggagagaggcagggtggggggggtaggaaagagggtagagaagaaggaaaactaggactgttcatagtgggattttaccattttagtgaaaaaaaaaaaaaagaaagaatgaaaaggaaatgaagaaagactaagacttttatatgttcctacaagtgtgaaaagatattcaggccgggcatggtggctcatgcctgtaatcccagcactttgggaggccaaggtgggaggatcacttgagcccaggagttcaagtccaccctgggcaataaattgagatgagactccatctcatacacatataaatataagtacaaaatttttttttgagacacagtctcactccgtcatctagggcagagtgtagtagtgcgatcacagttcactgcaacctctgcctcccggattcaattgatccttccacctcagcctcctgagaagctggaactacaggcacacaccaccacgcccagctaattttgtattttttctagagatggtgtctcactatgttgcccaaactggtcttgaaccctggactcaagcaaaccaccctcctccacctcccaaagtgctgggattacagacatgagcccccatgcccagcctaatagttatatttttaaaacaaaaaatatatatattcaaccaggtaacactgaatgcctcaaggtgggagtgagggagagttgaaactggggttgggggttgtgggagagaagaatgcatgcactctttcttcatgcacctgtgtaattaatgtttgacttgctccaggattgggacagcgtgactgcagcacagccagccagctgaaagcacaacactgagaaaagcaaatttgggaattgctgaaggggaaagagaggaaaataactgtggaattctgggtgcttcccaggaggccagtattacagcttagaggccaaagcagtcagcagtcaagagctggcatgaggccagtacagctggaaacacagcaggtggagtgaggtggagggaaggaacacgcaggctcagggatccggcttaggaaaaatcaggctgggggacttaaagtaaggtgagcaggaatcataactacttaggtttacctctgtgcaaagttttctactgaatgctgggacagaaactcaaaaccttgcccttcagataaggctaaatattacaaaaagaaaatttccaactttcctttctccctaaccccacgcagtcattgtcccttattggagcagcccagaaagccctggatgaatcactggctgctattctattctgcctgggtcggtaacagttctccacctgttcctgtctataagcaaagacattctctttgtctgcctcccagtcttctgcagtcaatacactggtgtcaacttatcagagttctcgctctactaaccagttgtgtaacctggggactgaccctctcagacttccaaattcctaactgggaaaactgggaaaattaacagaacatagctcatggggttgttgtaaagatcaaattaaataattacattagcacaatgactagcaatggaaagcccttggtaaatgtgagctgttacttttaggcaatgcttcatatactgctcacagtccctataatataggtgcttgttagagttgacttaagttttctaacattaagtagctagtaaatggcagagctagaatttgaatccatattaaaaatttatgtacccaactaataattattttgtctccaactcttcctctccactgtcttccctttctttaatacatattagcctgtccccttctccattctaccttcatcaatttctctttctctttcctgtccctaacctgcacacactggaggccacaaacacacactctaagcataaagctgagtgtgagattaaaacagaagaggatacaaatcagaacctattggcagtgtcttctaaagccaaacaaatgaaagaaaggagtgtttatgtctaccaaaacactcagacaataaatagagcagctttattgaaaatagccccaaactacaagctacccagatgcatatgaatagaaaaataaatattttattgtatgtacatgcaagtgaatattatacaaccaataaaaatgaactactgacacacacaacacaagggtcatgtctcccaaacatactggacaaattaagccagacataaaagagtacataccatagtttttatttatttgaagttcatgagcaggcaaaacaaatatatggtaatagaagaaccggaacagtgctgacctctttaagaggagagcactgagtgggaaatagcacaaggagtctcccagggtacttatgatgttccatatattaatctggtgatggttacacagtaatacctcaattaaaaggtcacgaagttgcacttaatattaacacactttatgtattccagacttcaattctaaaaaaagaacaaaggtaataaaaataatcagaatccatttcactgcagaagtttccaaggttctggggcagcggccaagatggcgagctttggtgctgtccgtgggtaaagtgctgatttgtctcttggctgagacctcagataacctcatgtatgagaaggagaaggagtagatcaggacacatccagtgacgtcacagccaagtacatctgctgctctctggacccacggcaagctctcaggcctgcagaggtttgcagcaaaatctacagcaaagctcgtccacagctgagctgcttgtgcttactctacatagtgttcctgtgataaccctcaaagttaattcctactgcttattttctggcacatctgatgctttttacttggtacattatggcactttggttctctatcttctccttatctgagcaagggcttcatgcctctaagatgtttattccctctgatcacaaaggtttcagacaaagggggactgctgaaatccactcatttggttatcaggcacgttattgcattattacattattacactttgtgggagagaaggacagcatgtgtagagactggacagtaacagtgtgtcaagacctctgcatatttgatttcaacacaggtgccaagaaaatttaacagaaaaagaatcgccttttcaacaaatggtgctgggaaaacttcacatccacatgcaaaagaatgaagttgggaccctttcctatgcaatacacaaaaaaaatggaccatatacctaaatgtaaaacctaaaactatgaaactcttagaagatataaaagtaaatcttcaaaaccctgggtcaggtgaagcctatttaaatataaaccaaaaccacaaacaaaagaaaaaaaatagataaaagttttgtgctgcaaatgataccatcaagaaagtgaagatgcaggctaggtgtagcagctcacgcctgtagtcccagtactttgggaacccaaggcagacagatagcttgagcccaagcattcgatattagcctgggcaacacagcaagaccccatctctacaaaaaatacaaaaattagccaggtgtggtggcatgtacctgtagtccaaactactcagaaggctggggtgggaagatcatttggacccaggaggtggtggttgtagtgagccgaaatctcaccactggactccagcttgggaggtaaactctgtctcaaaaaaatttgtttaaaaagcctctgtctcaaaaaattttttaagaacgtgtagatgacccacagaatgagagaacatacttaaaatcacacatctgataaaggacttgtatccacaacatataaagaactgttactcaataataaaagacatataacactatttttaaatgggcaaaccatcttaacagacatttttccacaagatgatgtacaaaagaccaaataaacacattaagagatgggcaacatcattagccatcagggatatacaaatgaaaaacacaatgagatcgacttcatacacctttgattggtgtacaaagacaggcaagtgctggtgacgacgtgaagaaactggatccttcatacactgctggtgtgaatgtaaaatggtgcagctgctttaggaagcagtctggcagttactaaaaacttaaagagtttccatttgaaccagcaattccattcccaggtatgtacccaagagaaatgaaaacatatgttcacacaaaaacctgtacatgaatatccatagcagtattactcaccatagccaaaaactaggaacaacccaaatgtccttcaactgatgaatggggaaaaaaatatgtatctatagaatggaacattatttagccattaaaaggaatgaaaagccaggtgtggtagctcacgtctgtaatcccagcactctaggaggctgaggcaggaggatcacttgcagccaggagtctgtgaccagcctggacaacacagcaataccttgtctctacaaaaaacaaataaacaaacaatggaataaagaattgacacatgctactatgtaaataatactgaaaatactatgctaagaagccagtcacaaaagacctcacacagcagttcacatttatatgaaatataaatagccaaatccaaaaagacagaaaacagatttgtagctgcctagaacttgggggtaggggagtgatacagaaaaggtaaagggtttgttgttgagatgatgaaaatgttaagttagacttcagagatggctgcacaattctctgaatatatttaaagtatttagttgtaaactttaaatgagtgatttgtatggtatttgaattatatcttaataaagctgttatgtatttcagaaaagaaaggaatcaggaaaaaggagaataaatgactacgaaatttacaaaatgttttttacaaaacccttaaggctactgaggttgcatgaggaaatggaaaaaacacatgactatgaccaatgtcagaggtgcacagatctatttgtagctctgcctctccatatcgatcagccccatgaccttggtaaagacacttatctcctccaggcctctctgaaaatgaaggactacaataggtcatactgtagttcccttccagccctactatatcctcattcttaaagatgcattacagtttagtgaccacagcctaacataataatgaagaagaagataaaggaataataacagctagtactgactgagctcttacttcacgccactgctgttcctgtctcagctcgttaaattttcacaacacctccctgagaccgctgttatcctcattgcacagatgaggaactgtggctgagaggggatgagagttgtggaatcaacatagaaaccaaccagtccacattaaagcaagtggacagaaaacagtaagagggaggaaaccaagcattcgttttttaagggactgatggattctttaataggtttagctatgctgtgagggtttttcagttctgctgtgagggtttttcagttttgctggagagtttagggaagaattagagatgaggatgaagaaaattaagcaaaaaaaaaaaaagcaaagcattttattcacgtcataaaaaagcaatacagctgggtacagtggcacatgtctgtggtcccagctactcaggaggctgatgcaagaggatcacttgggcccaggagttcaatgctacagtgtgctacgatcacgcctgtgaacagccactgcactccagcctgggcaatatggtaagaatccatctcctaacccactcaccaccccccccaaaaaaggcaatataattatagtgtcctatgtggctcagctgagaaatgctgatgtactgatactactatgtagttaggaataaggtagacgggaaaaaagtgtgggttttacggagtaaaacaaaattaaatcctcaacttctttaccagggataacagaaaataacaatagataatacctaaaattgaaatcacaataaatataaatatgaacatatcatttctaaatatagagggaaatgccagaaggaacagcttacagagttaaaggtggtgccctctgtgatgtcacactgaagaatgggcagcagtgatattaaagattaatgtttttgtgataaatcttaaagtacttttgaatttcttaagattatctgcatgtatcatgcttttttttttttttttgagacagagtcttgctctgtcgcccaggatggagtgcagtggcccaatctcagctcactgcaagctccgcttcccaggttcatgccattctcctgcctcagcctcccgattagctgggactacaggcacctgccaccacgcccagctaattttttgtatttttagtagagacggggtttcaccatgttagccaggatggtctcaatctcctgacctcatgatccgcccgcctcggcctcccaaagtgctgggattacaggcatgagccactgcgcctggcctatgctctaatttttaagtaaaaattaaattaacacaaaacaaaaaccttatccaagtttaagctgggactcaaatgcaagtgtgagtccaaattccaggctgtgatcaacatactctgtggtccaacttatgggaccttttcccatatgggatttatataaactgctgttggagatgcctttatacaaattaagtagtttttgacataatcaccaatatgagtcaatgtatgggagagaagaaatgaaactctacaaggtacaactccctctttaccaacaaacacgaaactgggatgagtaacatctcagggcatggacttatacaatacttagggcacaaacataaatgttggcagcctccctgaaaatgtgagcagctctcaaacacccacagatattttaatgtgtttttctccacttgtatccacgtagagaggttccccagagatgacctcaatttgaatccagaagaagacagcatgcctctaagacacttggagaaagtgtcttagctctcagacatgaaatcagtaaggtaagaagaaggtgggaaaatattttcctaccaaaacagtcacctgtattttagtttaactgattcccaggttcaagcaattctcctgcctaagcctcccaagtggctgggattacagacacccaccatcatgcctggctaatttttgtatttttgtagagacaaactcaaaagctttctgatcactggaaaagaacctgatcatctatgagaacagaacaccccataacaaaacaggaacatggggccaggcatgtggctcatgtctgtaattccagcactttgggaagtcaaggtaggaggactgcttgagcccaggactttgagaccagcctgggcaatatggtgagacactgtctctacaaaaagtgttttaaaaaattagtcaggcacagtggcgcacacctgtgacaccagcttctcaggaggcttaggcaggaggatcacctgtgccgaggagttggaaactgcagtaagtcatcatcacaccactgcactccagcctacgtgacagagtgaggttctgtctcaaaaaaaaaaggaaaaaaaacacaggaacacggacatcacaaaaccacactgggctttggcaaaacctcacctaacacggtttccaggcttcaagtcaaaagttggatataagaatgcagacttggccgggcacggtggctcacgcctgtaatcccatcactttgggaggccaaggcgggcagatcacctgatatcaggtgttcaagaccagcctggccaatatggtgaaacctcgtctcgacagaaatacaaaaattagccaggcatggtggtgggtgcctgtaatcccagctacttgggaggctgaagtaggcgaattgcttgaacctgggaagcagaggttgcagtgagccaagattgcgctattgcactccagcctggacaacagagcgagactcagtctcaaaaaaaaaaaaaaaaaagaacgcagacttatttttttatttgccaaaataaagaaaaaataaattattattctctaccatcctcgaataagtgtttattataccccaatattagaaggaagaaataaaagtaaaagataaagcacaccagtgacaaaatggatatgtttcccaccatgaatgcatatttcgtttgtggcagtttaaatattacactttgcttcaatgctgtctgctggttacaaatagcccagggccctgctcctgatcacagctcaaaggaaggctgcctggactgatttaacgaccatctccaaccagaagctgcctccaatttatctacgaaacaggtataggtaggggaaagagcagaggtgagtatggttttctgcagtgggcagtttccttctccaaggccttcctccacatcattcagcccgcctgacttcctttcacctgcccctgctgcctgagctcctgctgggggttgcagtgatcaaagtcaatacaagcctcactttagaatggcttccataccatcaatccacgtttgaaaaacaaccaccaaaaagacttgtgctcattggtaaacaagagtatccccaccaggcaggcccacagcctaattgggagtgactcagctcatcaatgcaccagactcggccgaaaatttctcaacttgttgatacaaagctagacattaaggtggaagcggagagcaaagagaagcatttaagttcgctgggagtcccagggtccaccattaagccccctgttttcggcaatcattttgcattgctaaggacagtggaagacctggccccaatccaccacagtaggcagaatctgaatatgggagtaaaggttccaagcagagagaagtcaggcgattaagggaagaaacaggtctctttaacaattaaagcctaccttatgatcatgttattacacttggaataaatgttacctaggagacatcatgcttaaagcttcacatattataacaaccttgggcaacctgaccacctgtgacataatcccagctctactatgtgctggctgtgtgttctcaggcaaagttcttaacctctctgtgctcagaatcatctgtaaactgggaataatcatgagttctacaactcaatttagagttataaggtttgaagttgatagtctaggtacaatacctggtacatagaaaggagcaaaatggtagcattatcatttcatgatggttattattattattcccactttacagactaggaaaccaaccttagaaagaatcacaaatttgtctcaagtcacacagctgataagtgggctgaactgggtctgtctgatgaactctgaagcccattctctaattacctattacagtctctcctctccccttgtagttcctgcccttgtcatccctaacagacacatggcatcagctactagaatctgtgtgattaaaaagttgggctcagtggctcacgcctgtaatcccagcactttgggaggccgaagcaggagttcaagaccagcctgggcaacatgatgaaacccagtctctactaaaaatataaaaattagctgggtatggtggcacacacctgtagtcccagctactcagaaggctaaggcaggaggactgcttgagcctcagaggtagaagttgcattaagctgagattgcaccactgcactccaacctgggtgacagagcaagaccctgtctcaagaaagaaaaaaaaaaatagccttggaagaaaattcctgtaaaaacccacacagtagtaatgataacagtagtaacagtagtgctggcagtgatggctgctgtcatcatcacagtagtagccaaaatcagtgacccttagcgcatgtcactgtgggctaaatggtatatatacaacatctcatatcccctgtcaggaaggactccatgtgtcacaattcagccaaaacatcagggatttggaaatggtatcaccaaaggagagctatatgttggcaggacaattatgaacaagaaatactgctgactggtcccaaaacaaatatctttatgacagatgaggtgggagaatcagcatatgaaatggccatgtcataaaagtagcattccacgcttcaaacttgaggagataataaacggctgacaactagattccaccgggagaacatcctcactagcccatcacagcagcaaaggcagggaagaaacacttttaagttttattcacttagttccactgcactgagagtaaaatccaaaaaactagttgtaacctcctgaattaaagaaaagagaaagatactactgttggcctgggacacatctcagcaatatctcatcactttcgtcctcttccgcattttcatgggaaataaaatatctctggcgtgtgtgtgtgtgtgtgtgtgtgtgtatgtaacagggtctccctctgtcacccaggctggagtgcagtggcatgctgccacctctgcctcccgggctcaagcgatcttcccgcctcagactcccaactagctggggctacctaattttagtattttttgtagatacagggtttctccatgttgcctaggctggtcttgaactcctgagctcaagcgatccacctgcctcagcctcccaaagtgctgggattacagaaatgagccactctggcatctgattttaactcttctgcaccctgagattaagaaaggcaagcactgggacttgttcactgctaaacacccaatactcttagataagagagtacctggtattaggaaacagataataaatatctgatcaatgcataaatgatggatctaaatctcttgacaaagccaagtgcagtggctcacacctgtaatcccagcactttggggggccaaggcaggaggatcactcgaggccaggagtccaagactaggctgggcagggtggcaagaccccatctctaaaaaattttttgtaattagctgggcatggtggtgtgtgcctatagtcccagatactcaggaggctgaggcaggggcatcacttgtgcccaggcgttggaggctgtagtgagccatgatctcaccactctactccagcttgggtgacagagccagaccccttcctcaaaaaaaaaaaaagttaggacttccatatgagtataataagctcatcacacatttgtaagctcatcaaatgatttttattttgtcttaagaacgtctaggtgtacaggaatgtgttctcaagtctatgggagggggattcagctcctagtgttcatccaagcacttttttttagcaactgggctgaataggagaggaagcccttaaattcctttcttcatctaagtaggttgtggtcaaaaaggcataagagcctctggaaagccagtagaggaaacggccctagctaggcagtgcccatccaaggcctgtcaagaggagatcaagttctatcacagatcaaatgacaacacttcctattccccaagcaaccttcagtttaggaaactcctgacttcccctctgaggtttgccaacagggagaaatgcattaaaatgcaacaataaacattctatccaaagaaagttggttttctttctgtaaattcataagcagtcattttgatctctgtatcattctctgtgaggtgggttgatgtgagtttcttgggaaacaccctttgtgaggctccttgggatcactctaagatgtacctttcagacaggcttcttcagttagtaacagaaaccaactctgcctaacttaaagaagaaaaagctgtttactacatggacacaaaagacaaagctgaagaaatcgccttaggaaggtaggaaatcaaaataactctaaagacctaggaggcaggaactagcaatctcttctgttcacctctgggtgaatagtttttatatcactcagttccatactcaaattcaggaagagtatgtctgattgacagagcttaagttacatgttttcccatctacaggatggcagggaacctcggttgaccatcccattaagactaagggagacattcctcaactggggggaaaaaaggaggaggcaagagagagaaagaaaggaaaaagaagagaataaatcagaaaagaaaatgtgcacgccaaaaatgcacaagttgaccaggcacagtggctcacatctgtaatccctgcactttgggaagctgaggcaggcagatggcttgagctcaggtgatcaagatcagcctgggcaacatggtgaaaccccatctctacagaatatcagaaaaaattagccaggcatggtggtgtgcacctgtagtctcagctacttgggaggctgaggtgggaggatcacttgagcccaggaggttgaggctgcagtgagccatgatcacgcaactgcatttcagcctgggcaacagagcaagaccctgtctcaaaaaaaaaaaaaaaaaggaaaaaagaaaggaaagaaaagggaaaagggaagagaaaggacaagttgacctcacaaacaagcagtcaggtatcttagctgcccctaaccagtggcctacatcaacaatttatacacccatttatctccccagtttcttttaacattccagtcatttcgtggctcaagctgtagtaaaacgtcacaggtctggcaataccacagccactcaagtgaagagtacagtttaaaagcatatgttcgaaatgagcccaaaatattagcaaatggcataaaaaaggattcaggcattttactacacaacagttattgaagttggattttgtgttacctaaacaagttgaaaaaaatatttcacaaaaccctcctccacagaagttgtactagcaaattccagtctaaaagaagtaaaatcaaataattctgaaacgcaaccctcaagaataaacaagaatatatattttataaacagggtgggtcacagtaaggaagaatttaatacttgctagacaaacaattcttcacaacaattataacaaagacttagctctggaattgtacagaaactggcaatttgctatgagattctacttctggaagaccacccagtttacatggaatgtgtcctttactgaattattaatattcacaagtttcagaagatattctatgaaaaagaagtgttgctttaaacactggcatcagactatccagttgtgagacaaatgacaccttcctgaattgccactgcatttcccactgttctaaccctctcctcagtctgattttccctgtctcttgccctcagacagagggagaaacaatggctgcagcagtaacaactgtttatcttaggttttgtgtacacatgaattgcctgtgggcgttttgcaaaatgtcactcccccgaataaactactggagccagaacatttcctgttcatcgaaagaaataaacttttcagtcttaattccccagtctaccaaaaagaaaaaagaaaagaattctttctgaatcattccctaaaaggcttttaaaaaaaatcagaaagaaggaaaatgaaatgagactctagcagaaaagcaagacagaatacacttatcttaaagggaaaagaacaagaatgaaaagagcaagataaacagagagtagaagaaaccaaccacaggttttattaaagggatttcaaggtgatggtcaactaattagattcctgaattcacaatgtaacagaaagaaaaacacgtccgaataaagcctaccaactctctccaccctgccatgtgctgccttttcttagatacaacaaggaactagtgacactgtgcatatagcacatagcgatactgtgcatgaggtatccaagtgcagactcattactgatacacaaggaaaaattgtaccacatggggtggaagaacgaagggagaacttgaccaagctcccatctagaaacacacaagataggtgaacaatggccaaaaagtacttcccttaaatacaaaaagcatggcatcaaaatgtgagataaaattaaggaagaatacatttaagacaacttgaatccattttctaactactaaaatactgagctattaaacaactaattttgctatcaaatgaacaaagattttcttttcttttttctttttttttaagattcagggggtacatgtgcaggttagttacatgggtatattgcatgatgctggggtttgggcttccaatgatcctgtcacccaggtaatgaacacaatcccaccaggcatttttcaaccccttcctccatctctccatccccactttgggaggcccagtgtctgctgttcaacgttagttcccacttataaatgagagcacatggaatttggttttctgttagaggaacagagatttaaggattggagagagtataagaaaatttgtattagcatgatatgtaccaaaacctaaagatctaaaaccaagtaattccacatgtaatatttgtctcaaggaaatattcagagagatatataaggctgtatgcacaaaaattgttcatcacatcattgtttatgaaagcacttcagaaacaacctaaatattcaacaaaaaaatcacatataaaataaattacaaaacagtcataaaatagatacctggatgaaaaaacgttttcaggtcgggcgcagcagctcacatctgtaatcccaacaatttgggaggccgaggtgggcagatcacctgaggtcaagagttcaagaccagcctggctaacacagtgaaaccccatttctaccaaaaacacaaattagcccggtgtggtggtgcgcatctgtaatcccagctacttgggaggctaagccaggagaatcacttgaacccaggaggcagaagttgcagtgagctgagattgtgccactgcactccagcttgggcaagaagagcaaaactctgtctcaaaaaaaaaaaaaatagttttcacatatattgtgaacgttattccctatcaagtataatgagggggaaaaacaaaactcagagtgtgtgatatggtttggctgtgtccccactcaaatcacatctggaattgtagcttccttaatccttacatgtcatggagggacccagtgggaggtaccttaatcatgggggtgggttttacccatgctattctcatgatagtgaataagtatcatgagatctgacggttttataaagggcagttcccctgcacacgctctcttgcctgccaccatgtaagacttgactttgctcctccttcaccttccaccatgattatgaggcctccccacccatgtggaactgtaagtccattaaacctttttcctttataaattacccagtctcaggtatgtgtgtactagcagcgtgagaacgaactaacacagtacgaaatggttataatttatacaataaatgctcatgtgcttataggtggcatctgtctgcatgtgtatacatgcatacacacatatacactcatactacataatactatttaaaaatcaaatattgaatggtggttatctctgagcggagatgttacagttttatttatctatattatctaactatgcaaacaagtataactgaaagcaaaaatcaccttacaaagaataatgtgctatatacttaagtttagaactgtaatgggccaacctttcattccattgagaaataggctcttatattccgtatctccctattttgcatagttttattacctaataagatactgtttcacaccaattctgcacagaaagttcatatgtaaatgtcctattattagcaagattatatgttgtattttttgacagtcaaactgcataaatggatgaggacaagaaaatattctaaatagcaattttttttcatttggtacatcaaagggatttttcatttaatctcaaataagcgtgtctcaagattctctttttaaaaaaataataaaggcatgatcttcagcaaagactgagttacctccaaaaatacattctccccttcctccaaactctcagttgagcatatggctgccctcattaaaggcttttgttgcagctagttatggccacacgagcaaggtctggcttatgagatgtgagcagaagcacagtgtgtcatttccaagccgtgtctgtgaagagaagagacctgctctcctcttgtctccgtctcactagccagaatgcacaggaggacaatatctctataatgacagagcaatatatgagacagaatctcagtccccaaccttgcagaatcacagtagcgtaggactgttacatggctagaccgttacataaggtagaaatgaacttctactatattgaagccactgtgatttgaggtaactgctaatgcagccaaacctatatgttggctgatacacagaaagcttgaacaaaataaccagtattgaaccagtaaactattaatttctcctacctgatcctacacatctcttctccaaaaaacatttcagaatgggtatacaccactgtcatttcttaataatttaagaaaataaagtacctagttaatgtcaaaggcttctgtgcaaactcataaaatacaaggtgcacttaaaataaatataaaatactgattaagaatagtctaagttgaaaccaagattctcagacatgagtaaaataagtatgtatgccatctcaaaaaaagattccaaagatcatatgcatatttttatctgtatagaaaaattgaaaaaatatatcccaaactggttgcctctggaggattagaattttaggttgagaacagaaggagataacaggaaaaatttagttttctactttatattcctgtgttttatttgaatttttgccacaaacatgtattactttagtaatacacaaaaactacaaaaataaagcacatattagaactctgtacagcagactgataccagaaaaaaaaaaaaaaaagggcaggggcaagagggggaaataagatttctatctacaaataaaaccacagccttctgaattctgggatgtaaattcataaacctgtaacttctactgtgcattaaaaaaaactataacataccataaaacctgtatctatttctttaacttccttacctttaccaaataccacaatttctcttagacagagacagtaaacataaaactcatgaaaaactaaagagacagaaaaataaaaattctatgtctggttaggacgttaataagctcacaatcataggacaccactattatctaaggcacagtgttttcaatttggatagtaagtcagttcatctttgagcttcgatcaatgtcttaaagctttcaagaccacatgaggatatggtacattgcccattatctcacttactgagtgacctattattcattgaatttatttccacacaagagaacagcatagatacagtatcctaaatgatcatgcacataaaacaaacattaacatcatattcatcgttagcaactattagaacctgtatattacactctcaataactgactgtatcattcaagttgatattagttcaatatggtatattctgtgtttcataaagaacctatcaccaaactaagattttttgagatcagcaaaacccaatctttataaaaggtgcccagttgattagcgaaattaccttctctctactgtgaaaacaattcccactatccaacctgatggtaagaaagctgctacataattgtgtgtgaaggccctgaacttcaaacattcctagaacagatttttcctaatggtgacaggacttaaaatctaagaagccatatgaagcatcagaacccatctcaataactttacaaaagcacaagaatagtcaaggagaggttgagaaaggaagactatgtctttcatcttcagagtcagagccaagggaagtactgagcagggaattagtatatgtctagcattggcaaccaaagtattcaagaggcccattataaacctttatgtccaaaagaattcctatgaggctacgttaagaagaaaaacatgttggaatacattgcaagttaccactggcagatgttaagaaaataaaattatacaagtagtaaatgggataaaatttttaatgacattagaaatgaaaggagatttagaattaaaactagcaactggattcacaagtcttaaacacacacatatacacaagtacatacacatttaagaatctttaagattttttttaaacactcaaaaatgaaatactgagtttaaagaactaaaagctttaatttctcctttctaaaaaaaagaaaaaagccagaagactggccaggatgcccaagaccttccaattcaatgctcccaaaaactatgaaccacaaaatctgacagatggaaaatggttattccaaggggtttgggattctacaggtacaccagaaattatctgtgcgctaaaaaaatgtgagtaaaagtattttctataatatacagatgccatatatgtgtgtatgtttatgtatatatttatatatgtgtgtatgtatacatatgtaacaaatataatattacaaagatataatgtataatgacctctataggctagtactattcattatcagattcatagcagttttccaaaaccaagagacgctaaaagtacaactaatattaagtaagcatctgtgaaactttctgaagcatagcctctaaaagactgaaaccaccacactaatccagagtgatccttcagttgacctggctgatataatgtccatgggtcagagtgagatggctgaattaaataagcaaagaaagtaatcatctgatatgtaggagagaatgtgggcaaggagatgggaaagatccatcactttaaaaaggcaagaaccccttctgtttctgtctttttagaagaccagttgctgctacatattttgtatctgcacagacttttctcttctgggcttagcgacacactcaacattttcagtacagagtcatgattctctgttctctcctctattcagctacatcatgagtcatagtaatgactattcttgaataccactggtgacgttcaaaaaattctaagctcatgccaaccaacttttgaacatctgtgaggcaggggagaaatactcgcctaaaagctgctgccagaaacagtagtctgcattccaaagtcagtgcaacacaggagtttaacttgggaggccttaacataacagtaagtaacacaacagtgaaagaatctgtactaataaggaaaataataatgtcagttaccatctattgagagctactatattgagaaaatttacactcatagtatgggggcatggggggttgtcaggtaaggcttcctggagggggagccacctgagccaacaccaaaaagataagcagaatgtactggtatatacagaaatgtattggtatgtgttcacaacagagaagcatgaggatgctgccacatgtatgaagatggtcactgcagtgttccttataaaagccaaagcacacaagcaagctttgtgcctttcaacagattgttatcttaatgtctacctcatgctgttcacagaaaaaaataaaagtgggcaaccagtttttagctccagatgacattaaaaactcatgatatgccggccagtcgcggtggctcacgcctgtaatcccggcactttgggaggccgagtggacggatcacgaggtcaggagatcgagaccatcctggctaacacagtgaaaccccgtctctactaaaaatacaaaaaaattagccgggcgtggtggcgggcgcctgcagtcccagctactcgggaggctgaggcaggagaatggcgtcaacccaggaggcggagcttgcagtgagcagagatagcgccactgcacttcagcctgggcgacagagcgagactccgtctcaaaacaaaaaacaaacaaacaaaaaaactcatcatatgccttcccaactcacacacaggcacacacacacaccgaggaggtcagaaacatgttcttgtgcatccaacttcaaaacattaagctttataaaattcaacaatatttttctcatttcatgtctgaacaaggcccagcacagatccaaggaccaaaatttcccaaaggacttgcaagaacattccaactttaacaccacatccaacgcaaacacttctttaaaagaacgagcagattcacatagccaaaaactcaggagttgaacaagtcacaaaatatcagcccatccatttataagaggtacaagttgagaaccactatggttgaaggatcttgcccaaggccagtcatacagctggaatggcaacccagattccaattttagaactatcccaataagctacattgattgaactcctcctattgtacttgtcaatagacagctggaacagcacaaaacattaacttggaaagaaaaacaaaaataaaatgtatcgcctcgtttgtttagacaacaaaacctattccagcctgggcagtggttcacacctctaatcctagcactttgtgaaggctgacaggcaggaggattgcttgaggccaggagttcaagaccagtctgggcaacacggcaaaaccccatctctacaaaaattacaaaaattagccaggcacggtggcatgcacctgtagtcctagctacttgggaggctgaggtgggaggatagcttgagctcaggaggcagaggatgcagtgcgccattacacttcagcctgggcgactgagtgagcccctgtcacagaaaaacacacacaaaaaaaaaaaaaggaaagaaagaaaccaataacaagaagaaaaaaactattctaatgggtttgtaacatggacaactacttgctctttaaagaatgagacagataactgtaatggtaagaagtcatttactgagcacctattacaaatctggtaatatgccaggcgctaccacccatcactgaccaatcactgaactaggacttaggtaagcaccatcaataaaacccttaaagcacaacgggaagagaagcctgggctgctagcacaataagccccaacaaactaaaatgttagattaagggacagaagtattttctacttcataagttaattatacattaccaaggttacttttccccactattttgcaggagtcaacgtgatacacaatataaccaagggtgacaaaagcaaccatactccaaagtattcagcaaaatacttgacaagcaacatgcatgacaatagccctaaggtgttggaagactgggatacaaacccctgttgtctggggcctgttgtggggtggggggagggggagggatagctttaggagatatacctaatgtaaatgatgagttaatgggtgcagcacaccaacatggcacatgtatacatacgtaacaaacctgcacattgtgcaaatgtaccctagaacttaaagtataatatatatatatatatatatatatatatatatatatatatatatatatatatatatacccgtgttgctccaattcaaatttgtgacaagtaaccagttattataggattatgctggacaatgagatacaccccctcccatattgttctaaatagatactttatacagaaaactcattatagatactcattatatagagaacacagtctttaattagagtctctgaaatagctattccccatccttaattatgtaacacataacacgaaaacttctgatcacagcctgatgggcagccaatgggcaaattccctcaaggttcagtgaccctaactgtgaagctatttttctttaattatgttacagaaaaagatgtctcaatccatggtcctcctaagcttcaagaggaaaggttgggaggaaactcattaacttagttatgatcgtctatatttcagagaggaaagaaaaagagaaaactttgcataactttttgatggacataaaataatagcagaatcagattttgtttaagataataatagcagaatcagattttattaagtggcataccaacattttattaagtggcatacaaggcattcttgtgtttattttttagaaattatcaaaacctaccaaagcaaatctaaagaacgtatataaaagaacttacctaaaacattaaattaatgttaagtataattataacagcagctaacatttatgtattaggtgttaactgttcaactttacacattgttttaatgtctcccaaatcagcctaacagtaagacttacctggggcacttaatcacagaatccctggaaattctaattctgtagctctgggatgggtcccattattttaaaaaatgcattacaatcattcttatgaccaagctaggttaggaaacagattctcatgggctcttctttaacaatgacaggaaataggaaacactattagacccatttgacaactgaagaaactgaggcttagagaggtcacaaagccacccagggtcagaggcagaaacaaacagaaatgtgagctcagatttgtagcttttagcctgaaagtaaaactgcaatcattgttcctttccccaggtaacacaccagagaaggacactaacaacctcaatttcagggacgataaaaattaagtaacaatccattcttctcttattatctctctcagagtatctaagaaggctacactggtaaaaggctacagtgcagtttctggcacataagttactgaaaataagatttctttcctatctcccatccttcatcccttcttctctactgatgtcctctaattggagtcattagtcctctttctaccaagcaaagccaaaggttcccagacatatacaacctcagaaaaaaaaatgtgaaataaatggcagatactaacatcagatttactattcatttttctttttttttttcatttcatgaaaattacattcaaaccggtttcttgcctggagaaaagcacaaaacaaaatttacataacgcctttaaaaatcaaaacacaattaacgttaagtttcttcatgcattctcaaaaatccaacaatatagtttaatagaaaataatgacaagcaacatttattgagcgtatcaagtattaaatcactaattctcatcagaagtccagagggaattacgcgagtcccatttacaattaagaaaacagacacaaagaaattacaaattttgccccaggttacacagttactaagtggtaaagacagtatgcaaaattagaagaagaactactatttgaattcatgatttctttattacaattatctactgctgcgtaataaatcatcccaaaatataacggcttaaactaacaacaatcattttattatctttcacaatttctgtgagtcaggaatttgtacaaagcacagctgaaatgcttgtctctgcttcctgatgtctgaatcttacactgggaagactgcaggcaactcaatggcccagggctagaatcatctgaaacctcaggtgtgtttcacctcccctggaacacttggatgtggcctcaccatttggctccttgagctcccctgcagcctcctagctggtttccaaagtcaagtgtcccaaaagaaccaggtagaagctataccaccttttatgaccctatcttggaagtctcacagcactgctccaccataatcacatggccacccctccatacaaaaagaaggaacgagacatcactacccgcctccctatggaaagaatctcaaagttgtaagaacagcataatttctgccacaacccctaaataacaatcaataatatcatccctacctactagtgagaaaatggaagttcagaaaggctatgtgattgcccaaggtcacacaataaataatggcactaagatgccaacacaggcccttgtgactccaaatcctgttcaatttccattacatcatatttataaaacattccatctaaactgagttgttccttggtgaaagctaggacacatccatcttttaaaaataataataaagtgaaccattccaccaaaaatatgctaaaaggatatccaaatataaattatcaaatttggaaaggcagcaaatggaaatcctaatctaaagcattcttagtttaccagtgatgtcaaatgttagcattttctttgttgttgtaattgaggattcgtgtaagaaaagagaaatacaataccaagagtattcagtaaggatagtccttgaaaagactagcaaccacctaggacagtggtgcaaaccatccaattaagtctaaataggagatacccaggcaacacaatgaagccaatgagctacaaactccatctgatgccaaaactaaaaggggagttatcactcatcaccatcaactgcttttgaaaaggccaatcccagctatgagtgtctcttctggcatgggaaatttcataacacatctttattgccggctgaggccacttgcctcatccagattcactgccttatgaaaatgtgcaatatgaatgtttaccgttgtcatggaaccttcacatgagttcaaaataacacacacccatcactgtggcatttccaaacaggactgaatggttggaaacggaggtgctagctaatgttatttattaaaacaaataaaaacgtctcttttattttagatatctgtgatgttcatggaggacttggcaatatgtgcatggttgggcataatctgataataaatccatcagtcctttattttgctactggttaactaaaatgccagacataaaggcaactgtacttctttaacaaatgtgtcttcttctaagtgggcagtgtcagcacttgttccctagacgggttcacagctagtacaacacacagagtcccccattcaaaacttcagcacctcttctccagcccctattctctccactcaatgtcttaaccatgggcattaaggaacacaacatgtgaaatatacaggcaatttgctggtctgagtttgtgtgacaccttcaggtttcagaaattaaactgccaccctcagggtcagagaccagaattctcaaaagtactacaattcattcgagaaggcaaggcatggtagacactacctttgtcttcaaacaataatctaattttttctttccaaatccctacaaagactctttatatgatcaatgaccatctatctatccggcagctttctgtatcaaagggaataacttaacctaaattcattatagtttcatgtgccaagtgcacagtaatggctaaaatcaaagtcattgagatgatgaagccccatccaaacttacgtcagttaccctccattttaacattgaaaaacagtatttatcagtaccatcaatatatttgcttctaaacactttttcctcaaagggacttttcaatcatcaaactatagctggcattaaatccaaaagaatattcaactatagcaagtaatatttccctggaaagctattaattattcagcattccttagctgcctacaagcagatagatacccaggttgttctttgttggaaacactcactcagcgcccctgcccccagcttggagaggaatacaggctgacccactaccattgcatctctgtaaacctcaagaagtgatgctgcaaggaccagctcaatagtacctaacagcctggctgacatggggaagcccccagccagaccaaaatctccacccactgcggtatttttctccctataggcaatagacaaaaggccaatgttcccactcactttaaattcaggcataagtaacaggactcagacaaggaagaaaactgaagtcccagtcaaaactgaaacccaccagcgtatataataagtatttttattattatcactaacagcagtaatcacgacaaaaaaaaaaaagtacaaccatgcccatggctgacaggaaggttatcaatcgaggacaatttagttatatgtggtttaggaagaagaaaaaacgacttgaaattatcaaaaccttggactcaggaatatcacatctgtggagcttgtccaagaaaactacgaatcatgtggacaaagatttagctacaaggacattcaacaaagagttgtttaaaacatgaaaaactggctggacacggtggttcacacttgtagtcccagctatgcaggaggctggggcaggaggatcgctggagcccataagtttgaagttacagtgaactatgattgtgccactgcactccaggcagggcatcagagaccccgtctcaaacaaacaaacaaacaaacaaactggaaacaacctaaatacccaacaataatatggacagtatacatccatacaatgaaatactaagtaaaactttaaaatgatagtgtaaaagcaggtgaggcttttctttgacatggcaacctgttcatgatttcacaggaaatgaatattcaagtaacaaaatgtatactgttcaatataaattttgattttatacacctacacataatacaactagaataatacaattgcccctccatatccgagaaaaattggttcccaggatccccttggataccaaaaatccacagatgctcacatctctgatataaaatggtacagtacttgcataaaacctatgcacatcctcctgtatagtttaaatcatctctagattacttataatacctaatacaatacaaatgttatgtaaatagttgttatactgtttttttatttgtactatatttagtacatcactaaagaataaaactggttatatttgataggtggaaaaacaggtgagtttttgggttagctcttcctaatagttctgtaataaacatgtaccacactcttttgcattagaaaattaatggactttaattccaacactttgaggggccaaggcaggaggatagcttaagcccaggagttccagaccagctgaggaaacacagcaagaacctgtctcccagaaaaccaaacaccgcatgttctcactcacaggtgggaattcaacaacgagaacacttggacacagggtggggaacatcacaccctggggcctgctgtggggtggggggcaggggcggaatagcattaggagaaatacctaatgtaaatgacgagttaatgggtgcagcaaaccaacatggcacatgtatacctatgtaacaaacctgcatgttgtgcacatgtacccctatgtaacaaacctgcatgttgtgcacatgtaccctaggacttaaagtataattaaaaaacaacaacaacaacaacaaaaaagaacctgtctccacaaaatttttttttaaaattcagccaggcatggtggtgtacccctgcagtcccagctactagggaggctgaagtgggaggatcacttaagcccaggaggttgaggccgaagtgagctatgatagcaccaccgcactccagcctgagcaacagagtaaaatcctgtccaaaaaaaataaaaaaagaaagaaaggaaaaggggggaaaaaaaaaacttaatggaaagcatttaagcatttcaacaacattctaccacagggatcacttttaaaggcatactgttttcagaaagacagatgttttctccctaaaattaacttgcagtccaaatccaaatatttaactcaagatacagccataaacagctttttctctctgtaggacacttaagaataaatgcttgtgattagactgaccaccagccagagagtttgatatacgatttggtttaatgttttctacaaaaatccctgctcaaaaggattcttctcaatgtatctatttccacctgtttcctgtatttgtttctccccaaaatcctacctttctgtggcataacatcgaatttttattcatcccaaataatggtccactgaacactttaaataaaaggcggctgggtagtagcttggagataaagcactattttacaaaaccctagggaaaggcagtaatatggaagagtttagtgtggcatcataaaaagtaggcatttacttgtaaaaattaaatgcacacaggcttgttcatttgtatgtgtacatatgtacgtgtaaaaaaattatatacacaaataaagaaaaacaacaaaacaaaacaaaagaaccctgaaattcaaattgttgacaggtatagaaaataggagtaagttcatggctccttcatttgctatgtctcatttcacaaaagttcctattattttgaaacacttagtatacaaagtccttcaaaatatactgacatagaaaagcaaatgaaaatgacagcaaccaaaggcaaagtaatagttaataataatatattgtatagtttcaactagctagaaggaaaatattgaacattcccaacataaagaaatgataaatgtttgagaagatggatatgctaattaccctgatctgatcactatacattatatgttttcaaaatatcatatgtaccccatgaatatgtacaattattatttgtcaatttaagtaaatatatttttaaataattaaagaaaatttaaaaaaatttttttttgagacttgggtctcactctgcagcccaggctgaagtgcagtggcacaatcttgcctcactgaagcctcaacttcccaggctcgggtgatcctcccacctcagcctcctgggcagctgggactacaggcacacaccaccaccacgctcagctaatttttttgtagagacgggtttcgccatgttgcccaggctggtctggaactcctgggctcaagcaaccctcctacctcagtctcccaaagtgctggtattacaggtgtgacccaccacgcccagcctaaaggtgttttaagtaatatattctaaatggatatctttcaaaacagaaaatacattcacagtggaaaaagtaaaatgtgaggattcagctccaggaaaagagtcatcagaggaaggaagttcataactactcaggtccattttctctttacaattcttactaataacatgtcccattatgaccattccgctgaagaaatcagacttatcaagaaatgaaaacagatcacaggaaggcaggggaggaaatgtcaacctcagaaaaaactgagatcatttcagaggtgctgacagataatggaaatgccaccatggcaaaacactaccatccttttgtgacataactgggataaaaatccctacagacaacaataccaggggaataaaattaagagagctgaaaacagaaagaacaactatgacctattctcatgttttatgctggaaaaatgaatttgcagcaagggccttggtgccaatgttaattctccatacatatggagccccaaagatatatctaatacagtttcatatatacttctgctaacttgcttacattctgaatgggactttcaaagggggataaagttaaaactggattaaggaacccaaattaaaataaacccttcctgatgcactaatttttcagataccatagaagtcttggtcaagtccaaagtgagagtgctaagatggcattgcacccacagaaatacagatcttgcttccaaagatgaggggaaaggaacatttttcacatatcttgcagttaatcacttacatacttagatcaaagggagtaatcaaagttccaaaagaatttcagattagcttttacattatcatgtgtcccatgattacaattacctggacccaaaaaaaaaaacgagctttctacactaatggatttgtcttggggacaagagataggcagtatacacccatcgtcttgctttgcacgttattgcaaggacacacgcaacatcgtgtctttcctatgtcaggcatccttggactcattaactcttaaaaatcccatccatcacccaggacataaaaggtaaaagtcacaacatcactaaccaaccttcaagataacttctcactcactacaatgaacatgatgtgtaagaggtagacagaaaacacagtgttataattgggaagaggtgataaaggtgtgagcaaaaattaaaagagtcatgtattatttgcctagtgttagacttgaaaaagggcttagtatatggtaagcactcaataaatgttcacttaatcataatatactagtacagaattacttagccatatctgtctgtccaacaccacacatataaatactcaccatttgactaggttttgatgaacttgaaattggcgtgaagagggagttagtaagaggccccacaaagaaacacaaaaaggcaactgtggtgaacaccaccaggttaccagatgaataccctgtctccccagtcttctagccattttcttacccctataggttacaaaagacatactttcagccatcattttcgcatagaacgccattacgctggccacaggtgcagacatctgacctattatgaaccattgagaatccttctccctggtatttacaatcagaactaagagattccagcttcagtctggatgaacccttgagaggaagaagtatatgctaggagtgtggacagccaggctctgggaagcagatcagtctattttgagagaacagaagaatgaagtaagagcgcattcagcaggaaatgaaaaatacctacagaaaaacctgataaggttcaaagtcttagtcccggggtgtttccaaaactggcctacactggataacccttaccttgggtatgcttcagatacccttacagtaaacatcctctttttatttttgctcaagagcatttatactacttgcaacgcagagcccaacataaagactattcctctctaaccaaaacaatccagagacaaggaaaaaataaaagatgacgccacacaaaaggaagagcaaaatagcccagggtggtctttccaatgatgaggaatccaccatgcaggcccagaccagagactgggagctcagagaaagtgtatggatgacatttctgttcatcctcggtggaagggtgagagtcacgtggtgacgaaattggctggagatatgagcgttgtttttacaatgttttagtatctgtgaataccacattcttttcctttcttgtacagtcttgtttgaaactctggcaaaacgctgcaaaggggaagcaattggaagttggctgagatgaagttatgtgatttcaattaaaaacattctctcacttgtggcttgctatcgctgtggaaaataaagaactgcaacggcaaggttttttccctattgaaaatatttctgttaagcttcagaacggtgaaaatcatttatctacatacacaaataacttctgttcaagttatatcggggctctggtccaatccccagattctgcgaaaaaggcaaattttgtatagactaattctactgttctcatttcctcagcaccctccacaattttgcatgtatacatcccagaatgcctaaaaactcacaaatgcctgctatcccacagggttccaataattagcacttttacaagtacatccttattttgctgcagaaaatacttacgaggttttaaaattcattattttttttaatacatcattttcactacacaaaaagaactaccaagactggtctcctcaaaaggataacatacttcttaatgtttccccatgatatttattaaacgctaaggaatgcaaaaataacatatatttgtgagagttctctgatatggattaatgatcatttctaaatatagcaatagtagggaataaatgtctggatttgcttatgtttactaaacaataatcttacaggttggtattttactgctttacaaatacgagggagacaaacaagcaaagctgtaggagagagaaaactctcacatcgcaattgtgtctgcctagagaatcaggttcctgaacactgctcccacctccaaagtatctgacaaggagggaagccacagactgctcccagtctgaatgcaagcccaacctcatatagtagaatgaaaacaaactcagccaagatggttccttagcagtaaaattcgcagcaattcaggaagatagcagcccctagacacggacttgagaacttgagaaggcagccacagcccagccccttgcgtatgtaaagtaagctcctacaagtcattcattcctgcaggaagcacccctggccctcctaagaatcacagcagaagggctaagttttagctgtgaaaagacagagcttgagctctcttacctgtaccagcctgtggctccctcccacttattccaatttgcgacaggcatccagggctcttcctgcaactctgaacggggcggatcctgccaagtctctgctcgtacctgaatgcaggaaactgagcatgctccccatcagggagcagcactagggcaggacacacgccattacctccagcttgggaatcagaccagatcagcagcatcaccctgccaacattaccaggaaagcagagagaaaatgaaaattgccttaaggagctttaacaaaatcagaaattaaggatcaaaaggaatagaatgaaagggtcataggtgtcactaaatggctagaatgagaacaccaaggtcaatccagtaaaaatcagcaggggttctcagctcaaagtcttttttggggggagtggtggggagaggtataactctgtcacccaagttagagtacactggcgcaatctcggctcactgcagcctcaacctcgcaggctaaagcaatccccccacctcagcctcccaagcagctgggactaggactactggcacacaccaacactcccagccaatgttgtttattttttgtatagacagggtctctatggtgcccaggctggttctgaactcctgggctcaaacgatcctcccaccttggcctcccaaagtggtgggattacaggcataagccaccacagcttgaagtcttaatattagtacaggagtggcaagtggaagcttggactaggagtcctgggtatgtatcctggatgccgtttctaactcaggtgtgactgtgggcaagtaacttctctctagagttcagtttcctcatttaaaaaaccaggataacagcaatgcctacttcctagggcagcataagaatgaaatttctgacacacaaagagcactcatgaaatgttcttatcaaatgtaatgcaacacacacatacgcacatacacgcatgcctgcacgtacacacaccttctccagagatcagtttccctaagacagagggaaaagaaggtactttctgaaaggttttgtttttatccttgccagtcagcttgatttactcaaacttcctaagtgcttatttcgatttgcctaaaatcaggcacagaaaataattctaggccaggcgcagtggctcacacctgtaatcccagcattttgggaggccgaggtgggaggatcacctgaggtctggaggtcaaaaccagcctggccaatgtggtgaaaccctgtctctactaaaaatacaaaaattagccaggtgtggtggtgcacacctgtagtcccagtttcttgggaggctgatgcaggagaatcgcttgaacccagaaggtggaggttgcagtgagccgagatcgtgccactgcattccagcctgggtgacagagcaagactctttctcaaaaaaaaaaaagaaagaaagaaaatcattctaatttcctcaaaaccatgtaaatctagcaaattagaaaggagcacagactacttaatctttgaggaagctgtcaagattgtgccataactttttgattcagttctcaactttccaactaattccagacagtaatgagacaccactaccctgatggctgatatttcacaaaatatgcagcaaggagagcccatgagggcaagaatggcctggaatgaccaaccctatgtcagtttctgttttgcctgcttgactctcaggattagaagggtgataaggtcacacaatctcaggccccttctcacctaccacatcttcaaagagacatccaccctctgatatatcaaactgggtgacaggaaacttggttcctgctaaaacccctccagtgaatggccactgcccttagaacaaaatccaaaaccctgaccacggccttcagggccctgcggcccggcctctgctgcccttcccaacccagctcccactgttctaccccagacctaccctcatccaacactccaagctctgcccacttctaggatgtagcttccaccatccctcagcccagaatgccctttctccatcaatcctatctctggctttctcattctccaggtcttagaccaccctggctaagacagatcacctacccaccattcagttcacaagtatcattgacaaaatagtgaagagtttaattgtttacagcctgcctccctctcctcactagactggaagctccaggaggtcagggccatatgctggtcattatgtggatgcagcacctgccacatggggagggtgaccaggcacataaggtggtgactgcctcttgaggctgcccatcccctctttggacagcatttggagacaaagcttaagcaggtaacaggacaagaaaacgcctcatcctggaactttctctgcaatggaaatcaatatgattcaacaaaattaggtactccgtataggggatcttaaccagaaccccacattacaatacacaggggagcttaaaaattatactaaaaataagaataacactaatactgatgcctatgctatatccccaagattctgatttaattgatattaaatctggtttatgtgatttaaatgatatgatattcagctagggttgagaactactgttttagagcactgcttctcaaactagttgtgagaaaggaccagctgtttcttatttcccaaagtatcaaaagataataaaaattaatgaccagaaaaaacacaagcacaccctacaaaatacaagacccaacttttaattattaaactcaacagatagacaactgtcttgtgcaattacatttctttttcttagcctgggcaacctagtgagacctcatctctatgaaatattttttttttctaattagctgggcattgtggtgtacacaccctgggtgacagagtaagaccttgccttaaaaaaaaaaaaaaattctttttcttatttttttagagacagggtctcactctgtcgcccacatcagtcttgaactcctgggctcaaatgatcctcccacctcagtctcccaaggagctaggattacacactcagccaattactattacatttctaaattctaagtctcaatttctatatttataccattgtgcacaggttaacaaaaacagactttgcacctcagctcaggtctacagagcaaatttagagtacactactcagaagttacagaaaaaggacaaaatgtagtctaacaacttagttgaggactgcactctactcaaattatactacacagtagtaaatgactacatatctaggcaggaatgcaccacacagatcagaacagacttttcatctgacagatttttgtggtgctttccggatataagaaagagttctccaagtgtttttaaaataccgaaataaaagagtttctgggatggtttatccacaattaaggcattctcttattaaaaacataaccttgcttttgctcacttggtttctttaacatcactatatttgagcatgtgttttccattagctaataatgcagaagtgtgtcattcttctccctgaaaatatactgttactatgaaggcacatcttgaaaatggtagcatctaataataaaaagaatatattactcgaaataggactaaactaggaaagggagactgatggtctgaagtgaattcaaggatgggagacatcaatgtgggttggaatagcacgtaaaagctccatgaagaaggaagcaccagggctgggtgcttaaagagaggttaggatgaggcaggcagatgggagcagggaaggaatttcagcccagtctgaaagggcagcatgtccactggtcagtttaatacagggctgaaccacagcaaggggaagatgcaatgggtgggcttcttttcccaggggatatcacccccacctttcttccaggcccattcctgccctccacaaaagtatccacaaaagtcaatgttttcattaaactctcaagggaaatgccaaagacaaagaaaagtttcaataatcaaaatcaaaatatacagccatcttagctgggtgtggtggctcatgcctggaatcccagcattttgggaggctgaggtgggcagatcatttgaggtcaggagttagagaccagcctgaccaacatggtgaaaccccatctctactaaaaatacaaaaattaagtgggcgtggtggtgggcacctataatcccagctactagggaggctgaggtaagagaattgcttgaacccaggaggtggaggttgcagtgagccaagatcacgccattgcactacagcctgggcaacagagcaagactctgtcttaaaaaaaaaaaaaaaatctacagacatcctagtaaattttggcaaaaaaaaaagaaaaagaacttgacaatgtacttctggacctgaacagtggtagagaaatgagatttcccttttgtctctagcattgatccacaaattcagtgagaaaaatcttgcctcttgtttacaaaaaaaaaaaaacactccacttggtgaagactaaggatttgtaaaaagaaatggctcgatgacaaaattaacatgaattctactctactgcctaaggagagcccttaattagatttttcaaattgctaaaaatattactgcttaactccctttggtttcaaatatagcatgatgcatagtattattgaaaataaacattttattaacatatatgttattcccatggatccttgagataactctagtgggtggatgagattatccttttcacaggctgagacctggtaaggctgagttatttgctcaaagtcctacagcttgtcagtgacaaaaccaagacttaaacccaggtctctgctgtcaaatcctttgaaagtcaccacatgcaaagtacttatccccccacacccgccttccctggaacttacaacaactcagccagtaaagctttggctatggaaatataagcaacgttggaagtaaaacgggcacattaaaagcaaaagcacagattggttaaaaatctaggaatccactgccttctggaaatgaccaaaagactttacctttttcaggttgaagtcttcagtggatctggtgttttcagatgcccagttctgaattctcattcagagttgccatagctccctctaggtgacttcacagtaacctcctgtgagcctgaggctattccttctccaccccaactaccttctcaagcatctgatggtcttttcaggcttgttcctgcctcagagtcttggtgtttgtcactggctttttaggaaacattcttgttcccagtatccatttgcctgacttggcctcatacttgcgtctcaacttaaaatgtcccctgtcacgtgttaccccggctccatcactctctgtggaatccctctgtttcactttctctctagtgcttatgattatctgaaattcttacgattcatggagcatgcaaataccacacgaacacaactaaaaaagaatcaaagttaacacaagaaatacaccaaacgccactcataaacaaacatgccctgaaggaaaagttcttataaatgaatccaaaataacagaagacatcaaatattgaatattttgctagctcacatacaccacacaataagaaacattcaaaggtagtatacgcagaaaatgtctacgaaacaacaaaacaccaacctctttttcctggtgttgaacactcttctctctgccaatactgtccacaataatccttaatttttttttttttaatcgagacagagtcttacactgtcacccaggctggagcacagtggtgcaatctcagctcactgcaacctccacctcccgggttcaagcaattctctgctggaattacaggcacccactaccacacccggctaattttttgtaattttagtagagacagggtttcaccatcttggccaggctggtcttgaactcctgacttcgtgatccacccgcctcggcctcccaaagtgctgggattagaggcgtgagccactgcacccggccaatccttattatttccgaatgaaacaacttttaattcctgcaaatcatcttctatatttttctctccatgaaataagtgaggttgcaaaaatcagctacgtaaaaactagtatctgagctgtccagcgtaaaggatattaggactccctggccgacttcccctctggaaaatgtggatcagcctttctaacagactcctggggcagctctccagcatgccttatcattagaggactctcttggtcattaaccataatgaccactcatagtctacatttcaatctgcaacacagtggggcagacactcagaagtctgcttattctcagcatgtaatgctgacatgagtcaattttttaataaaagtcataaatttatggttctaaaatatagagaatgacttctagttgtgatcaaataacccattttctagggatggtcttttataatgccaattccatgcacaattgggaatcaagttaaggtgtgtctatgaccaggtagagtattctcattaccagaagcctttgctcacagtgcctcatgaagctaccctcaaaatgtactcaagtatataaattttctcttcccgtactgacaccatcactgaagggctagtatcaacattatttccatagcccacctttaaggagttaatatagtctgggcatggtggctcatgcctgtaatctcaacattttgcaaggcagaagcaggaggatcacttgagcccaggagttcaagatcagcctgcacaacaaagttgagaccccatctctacaaaaaaaaaaaaaattgtttaattagctaggtgttgtggcacatgcctgtagtccaagttacttgggaggccaaggtgggaggactggcttgagcctgggaggttgaagctgcagtgagccgtgatcacaccactgcactccaacctgggtgacaaagcaagaccctgtctcaaaaaataataattaggccagtgtggtggtgggtgcctataatcccaactattcaggaggctgatgcaggaggatcacttgagctcaaaaagtcaaggctgcagtgagctgtgatcataccactgtactccagactgagtgacagagtgagaccctgtatccccaaaaattaaaaaaatgtaaaaagaaaagaatgtaaattagctgctgcccgctttatttcagggatgtggggattccaagcaagataatcaaacccagatagtatctacaccagcgatcactaacctttttggcaccatggaccggtttggtggaagacaatatttccatgggccaggggtgggggatggtttggggacgaaactgtcccacctcagatcatcaggcactaattagattctcataaggagcgcacaactagatccctcacatgtgcagttcacaacagggttcacactccaatgagaatctaatgccaccactgatctgacaggaggcggaactcaggcagtaatgctcacttgcccactgctcaccttctgctgttcggctcagttcctaacaggccacagaccagcatcagtccatgacctgggggttggggacccctcatctagctcataaccttctgtctatgtttggataatattaccttaaataactgaatataaaacaataaacatgtttaagtatttgaggctgccaaagtgaagagttacagagtacttttgttaagagatagatataattgagaatctcaaatttggaaaaagatcttttatccccccatgaaaaagttatcacaatgaaaacacatttaaaaatgaggataaatgcaatgctgtactgttgaaaatacacaagtctttcaaatgcatattccagaggaaaaacaagcacccttgaaaatcaatcactgaaaaacaaccaataaagtacgccaccattgcaaatggctttcctgtttacatactaatcgaagtggttgttggggcagcaccatgccaaacactgatacgatggaggacatggaagcatgagatagctgggaaagtgatcatctaatctgagaaaagagtcactactacttattaaagaactacttacttaaaacatcctgcgttagaaacgagtgcccccaacctccatcaaaactctacagtagcttcctatcactttcaggccataatcccaaaatacctctttaattttacttctcgacatgaaggtcctgacctagtagttaaatctctgctcatcacctatccaacacagtagatgggtgtctaccttgaggcctctttcagacatggtggacttttttttttttttttttttgagatggagactcgctctgtagcccaggctggagtgcagtggcatgatcttggctcaatgcaacctctgcctcctgggttcaagcgattctcctgcctcagcctcctgagtggctgggactacaggtgcacgccagcacacccggctaatttttgtattctgaatagagacggggtttcaccatattggtcaggctggtgtcgaactcctgacctcaggcgatccgcctgcctcggcctcccaaagtgataggattacaagagtgagccacagcgcctggcctggacatggtggacttttgctatccaacatctattttccccatttctgatagaagcaacccagttttgtcaaatgaaaataacttatctccataggctggtttagacattttactcaaactgggacatttgaacgtttgtccatggaatttgaatctcaagcagaaaaagacagaaaagggttggagttggctcatcctccgggggacgctctacagagatgtggcttcagctccctccaccagcagccccagagctgcccagcgtccacctttctgatcccatttttcaggtgtttctcagatcctgtaaactgctccatgtatctattgtttgttcacaacaaatttattttctgcttagggtggattcagggtagattttttttgcacttaggaccaaactatatcctaacttgcatgcttattaaagtcattcttaaaccttgggatcaaaactcaacacccctgattatttttaagcccttcaaagccacaccccaacagcataaccgctctctcttcaaaacttttatataagcctattatgtattcttactgttttcatttacccatgctccaaacaaattaccaaatcatacttttatagcccattggattatttcctagcatcaaacttggcacccagaaggtgatacaaatatttttatctattattaaagtttctgtgtaaggcactgtgcttagtggcttcctgttcgttactgcatttcattcctcattataggtagggttatcccatttggaggataaccagtccaaggcaaagagattaacttgcccaagggcattcacagctactaaatggacaaactgagatttaaatccaagtgtgcccttgaaagcctaaattctcaatcactgatgatagaacttgaaagggaaaaggcaggtgtgaaaataattctatcttagacatatttattttgtcatctctcgagtctagatatgaaactctgcccactgacatgttcatgaacccaatcttgaaagctatttaagtttaaatgaaacaatgcattacttcaggtaaatggaaaacaaagaaaactctgatctcaaaaaaaaaaaaaaaagagttctgcttcctaaatcatacacatcgtgttctcgcactgtagaatttctctctaatctgctctgacaaaaccaagtcaggggctggggagacttgaacagcaggctgaaaaactggaagagcccagtctgggattaaaaactagctacaaagggataattcacacatggatcattacgattcagggatggttaaaagcagctcacatctggttttatttgggctccctgtttcgtctaataaacaagtacatgtttaaacaaacaaaaacaggtaacaaaaaaatgtttttcaggtcacacgcaaagtaggattagtttggaaaaggaagaccagcacctggaaaaccaatttcacttaagtacctcaccaagagaccctgaccaagtgacttaatctcttaggaccagcttccttaatcaaatgtgaaaataaggattcttttttagttaccttagaagattattatgagaatcaaaagaaagcatgaacatggaaaattttatcaactctgacaagacattaacaaatatccccagaggaggtcaagcaggcctacctgagtctacaagtggaaaagtttgtcaaatacactataaatagctacactaggtacaagtcatgaaaggaaaaccagacacagcacctatatcagcaaacaacctatcagacatcatgaagaataaagtaaacttttatctagtttgatctctttaaatactaccaagccataaggggctgggcgcagtggctcacacctataatcccagcactttgggaggcaaggcaggcagatcacttgaggtcaggagttcgagaccagcctggccaacatggtgaaaaccctactacaaaaattagccaggcgtggtggtgcacacctgtaatcccagatactcagcaggctgaggcacaggaggcggaggttgaacccaggaggcagaggttgcagtgggcagagattgtgccattgaactccagcctgagcaacagagcaagactgtctcaaaaaacaaacaaaaaataataaataaacacttccaagccatgaagttcaattctttgagaaccattttttcatatttgacaaaattgcatttagatggaattaggattattcctcctccccaacccccccaaaaaatccaaaacatggttcaatgctttcaggtaatttctacctaaattctgacctaaatttgggagaggcaaccccaaagtatggcctgtagaaagctaataggtataggttgtttcggaagatggggaggtagtgttcagaaaggagagattccagaaagggttctgttagttcactaatttgggaaatgctgcattgggcaaaacaggttccttaaacacagtactgcttggagcatttaccatgagatgcctttcaaatccctaacaaagtattggaataaaaagcattttgcaaacttatttgcaaagagcatccttcaggcaggtgttccacagaaaacaaactgaaaacacagcagaagacagttaacagaggaaatacagggaggagaaattccttcggaacatatcgtattttttgaaggcaatgtgagtagagtaccatggaggaattctaccactgactgtgtatcccaaggtctttatcttcaattcaaggggttctaacactcctgaatattcttggcaatttagaaaacactcacatggacccagaaagcaattgctttaaacccagagagaccattagaaaggacaaagggagacaaagaaggaagaaaagaggatcttagaccctgctttctcccctaatgcttattaacaactaattggctttcatgttttctccattaggtttagcttcatgatcaaaatcacctcagggcatactacaatcaaccaaacatcagccttcaagagatgcaccatatgactacatccacaggtcagcatacatactcagccagcataaacccggcggggacttctaccaacagagggcctcctgtgaaaagcctggaaaaaaaagtcaactctctgttgcatagtgagcaacataaatccagcaacatttatttcagaacaaagatcgatctgttaactaattaatctgaacccacaaatgaacacattcaaactggggtacttcctggtttcatcacaaattcaaatgccatcaggggccatgcagataacctcaactagtgaagcagacaatgtctgaaaaagtagagaattatggagactaagaggggacctgagagttcaagccaagcctcaaggcattcacgctcaattcaattaaaacacagtgctgactctagctcccctcagacaaaacaaaacaggtgcagtccaaatccagcccacaggctaccagtttgagagctctgggaaggccaccatccttaagaggatttgagcctaatgttcgacaaatgcctaataagcatattaaatttacaaatcacaaagttgagaacagtatcaacccaaatgtgccaaacaaatttgcttatggtggatggatatttacaggatatatgtacatatacaaagggtttcagcactgtacaacagagttcaattgcttagagtaacctgctgcatgacctcgggtaagatatgttacttttctgagcatcaacttccccatctataaaatgaagataatagcacccccttgggatagtagtgaaagttacacaggaataaatttgtaaagctctcagcatgtagtaggcactcaataaatgatagttgataatttttttacaaagcatatttaggctagcattataatgcacatttagaacaactcattcaaggacaaagtcaatctcttaggcaaattgtgtggtaaatgatgttgatcagtcccttgcaagaaactgctaatcatatgaccagtctcacttagcctcttgccacacagaggtcatgaaaggatgctggtgccatctcatggtaatgctcagagcccacaggagatacaaatgctaggactgttcacatttgaacagcagcttgtacatatttagcattaattctgttaaatatttttaaatactcaattcagaagcataaatccaaacaccaacgggatgctaacacatcgctccatgccaaacaccttgcaatgtgcacagtcatttgccctctaaaattcacacccgttcaagttactcttctcaccttgtcttccagcagatgatctgcacacttgcccctttttagacactggctgctttctcctacagaaaatttaaattccaaattgtttgggtctttttctttttttaaaatccctgaagagactggactgggaagaggaaaaacgatgaataacacacaggtgcttcctacctaattaaaagaaaagtttacagctgcactggttgtgaatcatccctctgggttatccagtgtatccttcaagtggcacgtagttccatcaagagccatattccatatgctttcctgaaaactgccttctctttgcttggtaaaatgatgactatcaggtaactaatggcattttatacttcctggctttcctctctatggacaaagcagttcatttgtgcttccttatttctaaaaataaataaccctgaaaaaaggactcaacttagtgaatcaagctttgatttatgttgaaaaagcaagatgcaaatttgtgtatttattatcatttctgtgtaagaaatacatatacatttatatgatacatatataaaatgtgaatatatataatatgtatatatttatatacatataatttataatattcaatacacagtatattatatatatatattcatctatttctttcttttcttttttttgagacagagtcttgctctgttgctcaggctggagcgcagtggcacattttcagctcactgcaacctttgcctcccgggttgacgcgattctcatgcctaaacctcccaagaagctgggattgcaggcacatgccaccacacccaaccagtttttttgtatttttagtagagacggggtttcgccatgatagctaggctgatctcaaatttctggcctcaagtgatcttcccgtctcagccattgtattagtctgttctcatgctgcttgataaagacatacccaagactggataatttataaagaaaaagaggtttaatggactcacagttccatgtggctggggaggcctcacaatcatggcagaaggcgaaaggcacaccttacgtggtggcacacaagagagaaaataagagccaagtgaaagaggaaaccccttataaaaccatcagatattgtgagactttttcactaccacaagaacagaatgggaaaaaccactccatgattcaattatctcccaccagctccctcccacaacacatgggaattatgggagctacaattaaaaatgagatttgggtggggacacagccaaaccacaatcgcctcccacagtgctgagattacagatgtgagctactgcacctggcctatatacatgaatttcttacttaagtacatgtatcatacacacactaacacacacacacacacatacacacacacacaccctgccactacctccagagaaaccaaataatgaaataatgaggataggagaagacagttgtcagggataagttctactgttctcattgtatactttttaaaatcttggataatcatacacgtaatatattaatggtccaaaaaagttaactttgacttctttaaaaatttgtctggactgccaggtgttttcttatattttaaatttataatgtcaaaggtaattgaaataatctgtttttatttcttaagcttatccttagacatttccaccttcttacacataaagagagaaacatctagaaagatacatattataccattaactctaaaggatgaggagttacatggggctacagggtttcctttctcctctatccttctacatcactagtagcacttttgaaattgaaaaataaaaccaacaatgagataccactacacacctattagcaaagccaaaatcctaaacactgacaccaccaaatgctgacaaggatatggagcaacaggaactctcactcactgctggtgggaatgcaaaattatattgccactttggaagacagtttggcagtttcttataaaactaaacataatcttaccacacaatctagctagcaatcatgttccttggtattcagcaaaggagttgaaaacttatgtccacacaaaaacctgcacatgaaagtttataaaagctttatgtgcaattaccaagtcatccttcagtaaatgaatggataaaagaactatggtacatctagacaaggcaatatgattcaacactaaaaagaaacacaccatcaagccatgaaaacacatggaggaaacttacaaatgcatagtgctaagtgaaagaagccaatgtgaaacggctacatactatatgattccaattatctgacattctggaaaaggcaaaacgatggagacagtaaaaagatcaaaagttaggggagtggggagataaataagtagagcaccaagaatttttaggcggtgaaactagtctgtatattataatggtggacacgtgtcattacatatttgttcaaccctataaaatgtacaacaccaagaatgaaccctaatgtaaactaaggtctttgggtgataatgatgtgtcaatgtaggttcatcaattgtaacaaatgtaccaccttggtgggggacgttgataatgggggaggctgtgcacaggctggaagcagagggtacataggaaatctttgtaccttcctctcaattttattgtgaatctaaaaatgctctaacgaagtctattgtttttaaacagctactcagaaaaataaaagaatgaaactaattttacagttacaaagagaatatctacacactgaggtagggtcagaatcagtaaacatgaattcctatcattaagcatttttattaaatacctagaagggcatctgtagtttaagaagaaacttacataactctctcaggtcaattttctgcactctacttttgcttctcttggttaaaaatctggggttgggaacatatattcacctgtgcattatactcttgctccaaaacattttttttttttttttttgtgagacggagtctcgctctgtcaccaggctggagtgcaatggcgcgatctcggctcactgaaacctctgcttcccaggttcaagcaattctcctgcctcagcctctcgagtagctgggattacaggtgtgcaccaccacgcccagctaatttttgtatttttagtagcgatggggtttcaccatgttggtcaggctggtctcaatctcgtgacctcatgatccgcctgccttggcctcccaaaatgctgggattacaggtgtgagccaccgcgcccggcctccacaacattcttaaactgatttcttttgccaacaaatgagttgttttcatcctattgcttggtgactacgcaggtcagcttaaaattattgtttgcttaaattcaaagaatttaaaatgctcttctcttcaaattatccctaccaacaaataaatgcaagttaaggagaatgcttacaaaaagttaagaggagttcaattatactgcagagtgatctgtttttctcaaggaaggataataatcctcattttcaaaaaaaaaacaaacaaacaaaacaaaatgtaaactagccaaaagggtataaaattggaatcccaaattattctgggaaacaatactgtgcccacaagggcactcactacacatgaaaccagatagtatggttaacattgatctgtgaagactgaagactatcagttttcatgatccttgctcaacagaatttcactggcttttcctttggagaacactaaactaatttcattgaatttgagggagctttccccccaggagacaaaatgctgacttctcattctgaagttataaatgtaaaaacaatttgattttctacttcttaacctccaaaatgcttacacaagggccagatgtaatggctcatgcctgtaaattccagcactttgggaagctaaggcaggacgatcgtttgagcccaggagtttgagaccagcctgggcaacacagggagaccccatctctacaaaaaaatttttaaattggccaggagtggcgcacgctcctgtggtcccagctacttgggaggctaagggggaggatctcttgagcccaggagtttgaggctgtagtgagctacagttgtgccactgtactctagcccaggtgacagagcaagaccctgtctcaaaaaaaaacaaaaagaaaaaacaaacaaacaaaaaagaaacaaacaaaaaatgcttacacaagagaaggtatcaggaggtaacttggatatattttcattctctcattctctctccttctctctctctctctctctctctctctctcacatttttcaagttagaaaaaggcaacgttcccccattcgaggctttgttaacagtgaccattatacacggctggaataatttctctcatacagtctgtcagcctgcttcctgatatctaactactgctttgaacactagaactctcagttttagccagacatcacagaccttccatcatcttaaccccttttaacttttttcaatcttatcccattggtcaccaacttaagattcctggaaactcaggaatgaaataaatctaagtggtcacttggtctaacttcaggtccgatgtttaaattcacacaaacttctcgcaatgacccagactagacttggaaagctctgaatcagtgaacaaaccacatttcttggcagccacacttattttagggagttttgcacatcacaaattacccacaacagtcctgttcacatcctttagggcccacacagaatctggccaacttcatttacacatattagccatctatttaaagagctggtttccacctgcatcctgctgtattttttccttccagctaaacacctcgacctgtgccctcaatttctcaaagacccctgtgatagtcattaaaaacagtgatattaaaaaacaagggctctaaaattatcttctttttagttttaagcagtggggaacagaacatattggatcttccatcaaattctgacagtcacacacaaacaccgtatgaatttctaatcctgaaccatctctttttaaggtataatacatgtgtcaggtgaaaacctaatctctcttctcctagattcaatcacctcaaggcattccatatttataagcttcactctcttctgggacttaagaaatatttttaaaacaatatagtacaattaaatttagcccattcttccccttcccaaaaacatttttaacaacttttatttaatttcacatttcagaagaaaatgaaaattaagattaattgaattaccctccccccatgggttttaatttatatgacaacatttacatttggtaagaacaaaatggcagggcgcagtggctcacgcctgtaatcccagcactttgggaggccgaggtgggtggatcacgaggtcaggggttcaagaccagcctgaccaacatggtgaaactccgtctctactaaaaatacaaaaagtagctgggccaggtggcgggcacctgtaatcccagctactcaggaggctgaggcaggagaattgcttgaacccgggaagcagaggttgcagagagccgagatcacgccactgcactccagcctgggtgacagagcaaggttctgtctcaaaaaaaaaaaacaaaatggaattgggctgcagtttttagttacaattgacgctactgccaaactgagttcagttcagaagttataattgcacagaaaatgcaaacatataatcttgacttttactatcattttaacccactgcagaattatttaacaatgtttgccatgttggaagaaagctactacgtggtattttgctcaggccaatgtataacaaaaaaaattgatttgagaagataagattattaaatcaatctgtattttagcaatgacgtataattttttttttttttttgagacagggtctcactctgctgcccaggctggagtgcagggggcacaatctcagcttactgcaatctctgtgtcccgggttcaagtaattctcccatctcagcctcccgagtagctgggactacagatatgcgccaccaggcctggctaatttttgtattttttggtagagacggggtttcaccatgttggccaggctggtctcgaacttctggcttcaagtgatcctcccacctcagcctcccaaagtactggaatcataggcatgagccaccgtgcccggctgacttataattttcttaagatctttaccaccatattggaataacctccaatcaatacagaagctcttaccactcttttaatccattcctcctcaagaaaaggtcattccacaaaatcaatcaaaggagaatcaatcaaaatgattgacaattgtctgtagcctgctagtaaaagttaaaggaacacagaagaaaatcaggaaagaaagttagcctgagcccaggaggttgaggctgcagtgagccacgatggcgccactgcactccaacctgggcaacagagtgagaccctatctccaaccacacacacgacacacacacacacacacacacacacacacacacactacacaaaaggaaagaatatacaaaatgcattttggttagatatgaaaaacgaataataataattataggagtgtatcaagtacctgccatgtgctagctcttgttaacatggtttatctccatcactcatttaaccttcaaaatcgcctaagatacaggtactattattagttcccttttacagaaacagagactctaagagatgaaatgacatgcacaaggtcacacacaaaaatacagcagagactagacctagattcatgcattagcaaccaatgcaagagataaaacctggtataccggggttgaatagcatcccctcaaagttcatgtccacctggaaccacatgtgaccctatttagaaataggacctttgcagatataatcagttgaggtcataatgaatcagggtaatccctaaaaccaatatgactggtgtccttttacaaaaatgagcagatactcagagacatggacacacacagaaggaagacagccatgtgaagaggaggtaaaaactggaatgacacagatacaaaccaaggatgccaaggattgctggaaaccaccagaagctagaaagagacaaggaaggcaaaggatctatagatccttcaaaggaagcaaggccctgcttgacttcagacttctagcttccaaaactatgagagaatacatttctgatgttttaagtcacccagtttgtgatattttattacagcagcccagggaaatgatgacacctgagaggagaacacgatgaatcaacggagcattgcaatgccagcacttcatccccaaagaaaattggtgtacagaaaggagagacagtaataagaaccagccagttggaagttcagcaggtttctgtcaaataataaccactggcgtatttcctgctccttcctatagtctttagaagacccaacttacaactatgtctatgaggaactctggtaggactatacataataggaaaacataacatttttttcttgataacaggaacatctggctatgctgaacataagagattcaaaacagaggagatttgcaaattatagcttcccttagggcttagaagtgcttagataaaatttgattattccatactggcctgcaatttgactccaagatcccaggatcacatgccccaggcaaaagatttctaattcttctatgtaagacctatacttgctctatccattccgtatgtatccatccacccgtccatgcatgcacatgttaagcttgcattcaacagacatctttttttttttttttttgagatggagtctcgctctgtcacccaggctggagtgcagtggtgtgatctcggctcactgcaacctccacctcccaagttcaaacaattctcctgcctcagtctcccgagtagctaggactacaggcgcgcaccaccacgcccagctaactttttgtatttttagtagagatggggtttcaccatgttggtcaggatggtctcgatctcttgacctcatgatccgcccacctcggcctcccaaagtgctgggattacaggcatgagccaccacgcctggcctcaataaacatcttaaataataaacatcataaaaagcccactaggtacctggcactgttatgtccttggaataaatatgacaagtatatgccatatctgagggagtctaccctctagcaagaatgagagacattcaacaagtaactttaagtgagatgagagttaacaaggagacattaaggctgctatgggagataagagataaggttggccaatcacatacagctgtacagggggtacactgcacaagcacatttggccaagtaacatgttgggcctaaggtacagctctctccatatgcaaaaaagagcgttgtttcctcattaccacaaagaagcaattccaactagcatcagctctgaaactgtagaggataagcacctaatcttgcagcatcaatgcacctgaattttatattaagagtaatattaacagaaaataattaaagtgttttttaagtattagactcagctgtccacagaagcagaagcagtaatttatccaacattatttcatctcttgggtaatactaaaataattcaaggagatgtatgaataattgaagctaagaccatctgtaaaaaatgccattatggctctttaccaattgacactcatttaaaaccttgatttaaaaagtagcattttccatcattttaactttaggaagatttaaatgatttattaatcaagtgctgtttcactggactaaagtaggatcacaagccctattcaaacctgtctttcctttccacatatcaaattcttgccttccagagaagctactaaaatgcccgaattaagaaaggtcggtctacagcagtgggattgcatctccctccccagaacactgtaaaattagaaaattaagcctgtcactttaagatacatgagtcccatttcaagaatttctagcatcaaaccaagcaagaatatcattgggaggtgaatttatataacacaaggattctaggagaagccatcatttccgtggcaggaatcagaatgctcaaacaatatgaggcaagaatgaggccatcccgcatccccaaattatctacctgtaagtcacagcttgcttagagtactagagcaggtttcccagattgctttggtgggctcttaattaccgaaggtccaccactaaacctgtctctggtcagattcggttaggaaaccccacatcccacactgcccctcgctgctccatgcttcagttttcttatatatcaaatgagaataaacagccatgcctacctcataagactgttgtgggaatttacgagttaatccatgtaaagtactcacagtcatgcctggcacatagttaagtgctaaataaaaggtaattgttattattattttcttttgtagagcatttgatgaatttctgtccataaaaaccctctgagagaagtcatgaaaacaaataagtctgttgagctttacatatgccggtcttagccaaatttgtctgaccacaagatcctttgatctccccataaaacattttctatcactgggggagctcaagtcctgtagagctcaccatgggatacactgctccatgacgactgtgtctctgcctcgtctacttccattgctcatccaggaattgagaagactttatcatttaagccatgagatggctgaggaagaaaaaaccagatgcctgtttaagtcacctttagatttccacttcttcttccactgaattgtccttgaaatttcctttggaaataaattccaaggtaataaaaggcctcagtgcaggtagtgtttttttttgttttgtttttttgtttttgtattacttatacacaaaaagctggctgaaaggccaaacagaatgacaataaagggcaccttgcccagatttgatgtaaaaaggcccaccttgacccaacaaggacaactgcaaacaacccaaggccagtgaccacataattccctgatgcagagttaagagaaaaacaacaggaactttgttcactatagtcacacaatactggttattcctctttctatttctataacctagaacactaaatactcctttaacaattagaacgtttgttagattgataaaaataaagaaccccaacctctcaaaaaaatagtaatagctctctcatataaccttaaccatccttaatggactaactttttttttagacaggatctccctctgttgcccaggctgaagtgcaatggggcaatgttggctcactgcaatctccacctcctgggctcaagccatcctctcacctcagcctcctgagtagctaggactacagtcacgagccaccacactctgccaatttttgtattttttgtagagacagtttcaccatattgcccaggctggtcttgaactcctaggttaaagcgatccacctgcctcagcctcccaaagtgctaggattacaggcgtgagccactgcacctggccatatgtactcatataatcctcacaactaccctttgaggtaaatgcttttatctccattttgcagataagtaaactgaggtggcaagtactaagtaccttactcaagatcacacaactagtaaaagaaaaattcaaatcaaaatcatttctgttatttagtatttctttaaatgaagtcattttttaacttcaatagatttaacctgaaaggaaattttattacattattgtgtgttatcacctacactaaatagaaggtagtctgaaaaataaatacaatgtaaataaaagaatgttattgttacctaaaaactgtcatctgcagaagatccaagactgaagtcttcttttctctctctctctctctctctctctctctctctctctctctccctctttccctccctacacctccctctgtcagaggggttggaacagagcaactccatcttgaaaaggggctagataaaataagactaagacctgctggactgtattaccagtaaattaaggcattcttagtcacaggatgagacaggaggtcagcacaagatacaggtaataaagaccttgctgataaaataggctgcagtaaagaagccagccaaaacctaccaaaaccaagatggtgatgagagtgacctctggttgtcctcactgctacactcccaccagtaacatgacagtttacaaatgccatggcaacatcagaaagcctatatagtctaaaatgggggccgggcgtggtggctcacacctctaatcccaacactttgggaggctgaggcagatggatcacctgagatcaggagttcaagaccagcctggccaacatggtgtaacccccatctctactaaaagtacaaaatttgctgggcgcggtggtgcacacctgtaaccccagctactcaagaggctgaggcagaagaatcacttgaacccaggaggcggagtttgcagtgagccgagattgcgccattgcacaccagcctgggcaacaagagtgaaactctgtctcaaataaataaataaaaatggggagaaaccctcagttgcaggaattgcccaccccttccctggaaaactcatgaataatccaccccttgtgtagcatataatcaagaaataaccataaagatgggcaaccggcagccctcagggctggtctgcctatggagtagccattcttttatttctttactttcttaataaacttcctttcattttactctatgaattcgcctcaaattctttcttgtgcaagatccagggaccctctcttggggtctggatggggacccctttccggtaacaactctgccttttcatctcctgaaaaggtagatttgctagtgcaagaagatattaaagactcacaggcaccaaactaacattttctccaccacataatcacgcccactgaatgtgacctgcaaagggtctgtctcattgcaggatccaaagccatttaatgccacaagtgtgaactgctcccaatgccctcacccatcacaggtggtcccacactggaaaacattgcttcaagcagcattaacaactaaggatgtcacaaatgcagatttatttgccaagaaatcagggtgcttctgtaggttttttacataatgagaaatcaaagctatcaatgtaaagtactgcttttaggttcaatcaatcattggtaaaatgatacaatgaggaaaacctggcttggctggcagttcctgtggaaagggactgtggtttgggctgaccacaagatcaacatcagccaagagtatgacagggttctgaggtgagagaagggactcttaggctcattcctaacctgtcagggattgaatcaagggaagggagatcctgtcctcacagtgagccaagcagaccacacctggcgctcaggaaaatcaactacttaacacagcatgtccttttcagaaaaagcaatcaagaatgatgagtatctgaaaattaagccacttgaggaatatgatcaccctacttaaaattgcaacccaagtcccttcagtatacataatccccctcactctgttcttttttttcttagaattttcacctcctaatatgcaacacgagttacttttacatgaatttattttcggccccactccatgaagacaaggatttttttacagcagtgttcactgatgcacccctggtgtgtagagcaatgactgatacatattaacaccagacagccaactgtgtgcaactcctcccaatactaggttcactgagtttacagtggtcacttaatactggccgtggagggagcatttatacaaaggaaattggcaaacactacaatcagtgctccctgcccagagctggttcttaaccattaactagcactgattgcacttgctctgagaacttgaggcaacaagaatataagaatgaacttaaagaaagtttttcagatattgaactggtaccattgtttcaacagaaactggatgacctcatttgtcaggagcacatgagatgaaatcaatgtattgcttttccgctggcctcaactgctctatgagggcaggaatctcaactacatctctcaacattgtcacggtggcaagcaagtaactttgagttagttgctgtattccattgtttcctttcagccgaaagactaaaattctatagtacatgtcaaactacattaagtctaatttccacggttctaatcactagagaaaatgggtcaatgccttcttttaaatatgaaatgtgtagtttcccttttaaaacctacgttttcaaataaaaatgcaaccacaatgagagctgttacataaggaaaaccacaccttgcagggtgcccattatttcagcctctaagcaaaataatgaaaccttctctgtacttcaaaaggaccccgaagatgactgaaacagttttaattaaaaatgcaattagcatgagttttctgagatacaatgataatgggtgggcaggacataagaggctatcattgatgctttcagcttatttaatgaaaaaagcaggcccagaaccacagagactcacacctataatccaccagtttgggaagccgaagcgggagggatcacttaagcccagcaggtcgaggctgcagtgagccatgatcctgccggtgcaccccagcctgagtgacaaagggagacaatgccgcaaaaaaaaagaaaaaagaaaaaaacctgtgacaatgaacctgtttgtagagcacccctgtttgggacaacctatctatatacctcattcatcctttcatcctttctcctcaatctaactcaaattcatttcatatgtaggctttctaaaattgacaaaaactcagtcatcacacatgcagatatcaaggatgatttttttttttttgagaccgagtctcgctctgtcaccatgctggagtgcagtggcgcgatctcagcttactgcaacctccacctcccaggttcaagcgattctcctgcctcagcctcccaagtagctgggacccccaactaccatgcccagctaatttttgtatttttagtagagatggggtttcaccatattggccaggatggtctcgatctcctgacctcgtgatccacccacctcggcctcccaaagtgctgggattacaggcgtgagccaccgcgcccagccaaggaagatttttacgtcaagaattcaacaatgcaatccacataagatactagataattctatcttgaataacttgagaccctttcggggcacaaaagccataaaagtttaaaactccaacaaatgcccacaaacaaaagggcctcaaagagcaaatcaatccatggtaataattcagggtaagaagctgagttacaccaaaggcctgtggaatggagagtgggctggggagaaattctggggtctaatccattctttgacttttactaagagttatgaaactttgggcaagtcacttgaaccaagttgcagtttcctttatcagccaaagaggaaaatacttcccctgtgtatctcacagctttcctagaagggcaaatcacattaaaaattatatttctaggccgggcgcgttggctcacacctgtaatcccagcactttgggaggccgaggcgggtggatcaccaggtcaggagatcgagaccatcctggctaacacggtgaaaccctgtctctactgaaaatacaaaaaattagtcgggcgcagtggcgggcgcctgtagtcccggctactcagggggctgaggcaggagaatgacgtgaacccgggaggcggagcttgcagtgagccgagatagcgccactgcactccagcctgggcgaaagagcaagactccgtctcaaaaaaaaaaaaaaaaaaaaaaaaaatgttatttgtatctaaaggaaaaaccaaggtctttccattgtgtctcagtctttactactaacttccccaaataagatggagacgtatttatcaaaatgtccacttgtggccaggcacggtggctcacacctgtggttccagcactttgggaggcagaggcaggcagatcactttgtcagaggtgtttgaaccacagcaactccatcttgaataggggctaggtaaaatgaggctgatacctactgggctgcattcccaggaggttgggcattctaagttacaggatcagattggtcggcacaagaaacaggtcacaaagaccttgctgattaaacaggttgcggtaaagaagccagccaaaacccaccaaaaccaagatgataacgcaagtgacctctggtcctcctaactgctcattatatgcttattataatgcattagaaggctaaaagacactcccaccagtgtcctgacagtgtacaaatgccatggcaacgtcaggaagttaccgtatatggtctaaaaagggaagaaccctcagctctgggaattgcccgcccctttcctggaaaactcatgaataatccaccccttgtttagcatataatcaagaagtaaacataaaaatagccaacaatcagtccatgcttctgctctgcctacgaagtagctattcttttactccattgcttgcttctttttttttttgagatagagcctcactctgtgtcccagggtagagtgcagtggcacagtcttggttcactgcaacctccacctgccaggttcaagccattctcctgtctcagcctcccgagtagctgagactacaggagcgtgccaccacgcccagctgattgtttatattttttagtagagatgaggtttcactgtgttagccaggatggtctcaatctgttgacctcgtgatccacccgcctcagcctcccaaagtgctgagattacaggcatgagccaccgcacccggccctcccttgctttcttaataaacatcctttcactttgtggatttgcctcaagttcttatgtgagatccaagaaccctctcttgaggtctagatcgagacccctttccagtaacagcttgaacacaggagttccagaccagccagggcaacatggcgaagccctgtgtctataaaaaatacaaaaattagccaggtgtggtggcagacactgtagtccctgctacttgggaggctgaggtgggaggatcatttgagcccagaagtcaaggttgcagtgggccgagattgtgctactgcactctagcccaggtgacagagaaagaccttgtctcaacaacaacagtaaaagtccacttgcattcttgtgctctcttcaacttatattacagggtaaaaaaacagttccgctattattcctctctgtggcatatgaaaacctgccattacatgtggatttgaacccaattgtgggttcaaatgaaacagatcattggaaaccaatgaaaatcactacctatattttttattgcactgtgactagagaagggtaagtgtatacgccaactcatagaaaagcttgatgacaccaaactacctgctctccattgtaatactatcacatttttaaatactttcctgaaacttggagttaccaaatagtccagaaaatcagccacagagataaatcaacagattgaaaatccaaacacatggaaacaggggaaaaaatcgtatcgagttttctaatgtttgtggacacaaatgcttacaaatatttcaaaatacttcactaaactgttttatttgttaggacagaatgccttgaacttgcactcttctgatacgacttgtagattattttcttgcacattttctctcccaaccaacataaaataatgcaaacaaggtctgttcgaagactatggattatgttcttttcaaattacttgaacctgggaggcgggggttgcagtgagctgagatcacaccactgcactccagcctaagcgacagagtgaaactcagtttcacgaaacaaaaataaaaaagaaagattaggtaatatgttttctaaaactgctctctcccatagcaggtaactttgaggtatgtgtctgccccctaggtttcttctttggaacacaatccccttcagcattcccaccatcccgaacatatatataccatcaacagaaaaaagctccgggcagccctagagttccacccaccccagcaatggctgattgccttaggcatcggcacctaattgaagctctacctatgaaattctctctttccaggaagctaaaccacagaaactctctgtgactaaagccatcatataataagagagccaaaggggcttccaaattccacctcgtagatggaaaatcagagaaagcccatctatagaaagaaacataatcagaggaaagaagatccttcatgaggccctctccatccttccccttgggttccatgagactttgccgtctctagataataaattatccttcctgcttaggctattacttgcaaccaaagctgattcataattatgtttaaataaagtatgatgctacattactctataccagactacatttacttaacagtcctatcttttcaaagtttaaatcttgatatgaaagagaataccatctgcctctaggcagcacctaagaccaaatgctccattgaaaatcaggcattcagggaagcttacagttatacttgtttcaataagtattttgtttaagtgtgtatggctgaaagaacctgttccaggactaaactcaatattaatccacttgaagacaaaagccatatcttagccttggagtccagagagaatgcaaaatggctgaagtgcagtggcctaaaacaataagcatttattatctcacagagtttctacaagtaaggaacagtttagttcgtggctcaggatctcatgtggttgcaatcaaaatattggtcagggctgcactcatctgaaggcttgactggggctgagggatctgcttctgcttctaaaatggttcactaatatggctgctgatgagagaccctggttccatgctacgtggacctttctcattggttgcttgtctgtcctcatactatagcagctagccttccccagagtgacagatccaagaaagcaaggcagaagccacaattctgttacgacctagccttgggaacaatactgtgccatttctaccacatactgttggcttgaatgtcagtcctactcagcttaggaggagtccatacaaggccatgaatatatggaggtgaaaattattgggaggagaggaggggtcttggaggctagctacaattggctagattaggatagatactccttgaaactccaaagttacactaaatatagtattcggagtaaaagaagaaagatatcttaaatgagcctattttattaattgtttatcatcatatgtatgcacagcagcaaataaatgtattataaacatatccccattccggtcaggtgcgggggctcatgcctataatcccagcactttgggaggccgaggtgggcagattacctgaggtcaggagttcgagaccagcctgaccaacatggtgaaaccccatctctactaaaaatacaaaaaattagctgggcttggtggtgggcatctgtaatcccagctactcgggaggctgaggcaggagaatcacttgaactgcgaaggttgcagtgagctgagatcgcgccactgcactccagcctgggcacgacagagcgagactctgtctcaaacaaaaaacaaaaacaaaaacaaatccctattccttcaaagaggtgaatctaggtgagacaccaagatgtgcacaagaataattagagggtaattagggtaatgaactgattcttttttttttaatatattttaccatttttttttttttaagatagggagaggatcttgctgggttgcccaggctggtctcaaactcctggcctccagggatcctcctgtctcagcctcccaaaatggtaggattataggcatgattctaaatacaacagaggttcagaaaaagaagaaacaataggtcggataaagcaggggaaaatctttctctgttctttacaaataaaggcttaccttcaggtggcatctttaaccatctattttatagactacaagtaggactttttccaaacattcatttgatgttagcaagtgatttaacaggactaatggtgcagtacatttaagaaaaaggctcccaacctaattataaaaccgagtccctcttatattgggccatttaatggtgccagattgtggtgcagtacatttaagaaaaaggctcccaacctaattataaaaccgagtccctcttatattgggccatttaatggtgccagattgtgggctgagaagaaaaagttgttgtttttttttttttttaaggggaggttgtggtgggacattccaaaggggaacattgaaatcctcttgtgagcaaacatcaataagtaatctgcaccaatttaatctgcattgcacaagtatttatttaatcctatctatagtaagccactgtggttggtacaaacacagtaaagaacaacacagataccagtcctgcctttatcaggaaagacaaaacaaaaacaaaaagtaaacattccagtaaaggaatgattagtgctattatgacaaggaaagcatagggaactattcgatcaaagaagagaggttacagttccccaaatctagggtgtttggaaaggaagaatatccttagtaaatgacattgaagctaaaacctaaactatgtatagcagtcagctagaaaaaacaggcaagaaagaatatttcaggtggagagaaacacatgttttcaggccaaaagctggagaacaaggtgagtttaaagaactgaaagaggtttagtgattacaatgttgaacaaaagggggcatgtggaatgaataagaagaatggttttgtagattgaattctctgcagcaaactccatcaagaggtagaggtcaggcatggtggttcactttggaaggccgaggtgggcaggagttcatgatcagcctgggcaaaaaagtgagaacccatctctaccaaaaaaaatgttttaattagctgactgtggtggtatgtgcctgtggtcctagctactcgggaggctgagatggaaggatcgcttgagcccaggaggttgaggctgcagtgagccatgaggctgctactgcactccagagtgggcaatagagcgcaattctgtctcaaagaaaaaagaggtagagtctactacctcaccctttgaattttggctggcctggaagttgctttgaccaatagaatgtggtaaaggtgacactgtgtgagctctgaagaaagggcctcaaggggccttgccacttccaccttcctgcttttgaaatgctgccctgaaactgccaaataaggaagccagtctagcctactggaggaaaataaaccattgtggaaaagacaccaaggtgcctcagaggacagccagtaccaaggccagagacatgtgaaggaagtcacatcagaacttccagctcaaccaccacccaggtgaactcggcagatgagtaagcccaggtgaaaccagcctaagaactatctggccaactcacaaaatgatgagcaataacaaatcattggttttctttaaagctactaagcctgggggctttgttaggcagcagacagaaaaaagccacaacacacaggaccaggttaaggacttcaactgaccttcatcctaaaatcaatggaaagccatggaagggttttaagaacagactgacataatccattagtaccacagacacagtacctatgccaacaaacctcccaaggccctagaaataacaggaatatggtgggaggaagggaactgactgcaaaatacaaagagaaacagcagaatcaaaattcctaagcgtaacccacagcaagtcaactgcaaatcaaaaattcctaggtagtgaccaggtgtagtggctcacgtctataatcccagcactttgggaggctgaggcataccgatcacctgagggcaggagttcgagaccagcctggccaacatggcgaaaccccgtctctactaaaaatacaaaaattagctgggtgtggctggtacacgcctgtaatcccagctactcaggcagtgggccaagatcacaccactgcactccagcctgggtgacagagactccctctcaaaaaaaaaaaaaaatcttatgtagatatatatatattatatttcatcaggaaggtgggtacattttaatatgttagttatagaagagggcaatctccaaagtaccttacaccttcaaagtctcgtgcggggtgtgtgtgtatctgtgtggtgtgtgtgtagacagggtctcactctgccatcgaggctggagtacagtagcacaatcacagctcactgcaatttcaaactcctggactcaagcaatcctcccacctcagcctcctgagtagctggggctacaggtgtgcgccactgagctcaggttcaaagttgttgttgttgttgttggtggtggtggtggtgatggtggtggtgatggtgatggtggtggtggtggtgatggtggtggtggtggtgatggtggtggtggtggttgttttaatctctacctaattttctccacagacagtatctcctcctgatgattaacaattttgtatagcttaccaagagcaaaccctacaccacacccactgtcccaggaagagaatctcatcagggaaataaactagcaatagacaaggaggcctatgttctgaaatctgaattccaatagcaagttattactgtttgagattttgaagagctgtcaaaagaatggcagcctgacaaacaccttgaaaactcttgcagcctatttgcagacctcagccagccccaccctgacacttctcccttgcccttttgcctcagatttccaacgcttgctagctttgtctgttttgaatggccgtgctcagtgttcagctacggaaatcctctccttccccagctggctcaccaggaaattgtttagaagtcaggtttttcctggaggtggcccacaggcccacagagaaagagagaggttgtgtcaggggctgagagcactcccctggtgaagcaatttgtggatgatggtctgaccacaggcaccggcagcctctgcggtgtgaagccatcagggtgcatgtgtgtttgctaggtggcttgctttggataagcacaagcacaactggctatgcctaacctgctaaatagaatttttaagccacttcttttattttgtgggttttttggggtttttttagttacaacttaattaacttctgacaagcagaagagccactgcagacagtaaggtttgacaccaaaaaaagggaaagagataagtaatgaaactacaccaaaattaagtaagattttgcctaagggacattgttctgttagatgattactccagcccaaataagaattaatcaggctatcattccgtttgttggaaaataaaatatggcatttatttttttaatgtacttttataaaaaaagaaaaagagacattatcagaatcaagagaatacggatcaagcaatactctattaggaaataaatggctgaccagataacttgaccttaaaaagtatattccatattatgggtcaatatgatcactcttcctatcaaatccaagtgcatacaaggaagacagacttcaagctaccaagaacattcttcaattacctaagctacaaataaaaatagagcttccatgagaaataaagaattaggtcagtggataggaacagtttctttccatttaagttaactaaaatgttacttggggaaacaattttgaaatgtgctttaatgtaaatgttatattaaattaatatgaatattataatatattaacataattatactaaataaattaatataaatatattaaatgaactaatataaatattatattaaatatattaacttaatataaataaaggtctttaaggacctttaacaacaagctctgttctcacttatctgttcaaggtgattcgagtactattaatatttgcaggctggagatggacaagatgaccaacctctgaatgtcccctccatcttataaggacattgttaaaaatgacaacctccctactcgccaagagacttgacacttcttccttttccgcactgagacaggacaatttaaagcccagaataaaataaattaaaataaagtatcaagcatgcacctctttgaatgaagatttctcgtaataaacctaggcgggacatcctaattatctaaggcctgaagatgttcttcggtgtaacaatgacctaagatttatttatagttttcctgagactcattaaacatttcctgcaatgagaccacatcactgaaatcattttattgtgatagactggcagagcacaaggggaaacagtcctcaaagacaaaagaactggtgggtgtctttgtagcagagggcagtgcatatttttttagtgaggatgcaaccattgtaggtaaacagcaggaactctcttctgatgctatatcctgtcctgtttaactcattaatttaggagacctcagccactagagtaaaacactagcactagtaattcgtttgcgcccccatcccaaaatcaatttattaaaattatattgctaaagaaaaagaaaaacacataaactagtttactttgaactaacatggattatgcattaaatgggctactaagtcatcaatgaaataaattcttttgaagttattgtggccctacagttgtacatgaagagtctttctatttcccttttttaaaaaaaatgccttttgtatctcctgcaggtttccacatttctattcctatgggcaggaagactcatacagccaaatgtttagtcctcattattaaaaaatatacaaacatttcaccagcaagatcattatttcatagtctttcatgtttacactgtagggggtaaaatcaataactcaatgtgaactccgcacaaattaccaacagctaaatgtagatgatgacagtggatcttaaattactcataaacaaactgaatgaggaaaagtatcccaaagaaatattgtcaaatagccctaacgatggttcattttctaacttcagaaaaaatatttcaatggtgaatgtgaaattatgagcccatctaagtcattaagtaggagtgtcataggctatataaaataccagctcgtacttctccatactcagacaggccctccgatcttccctggactgtgtcatctgcatctaaaacccagtaagaaaggaaagggaaatcgatttggggaataaaaggacattagtagtcatggtatcaagtctcatgagggtttgagtctaacaaggtttggggagcaaagctgacattcctcatagtatttgaacattaataagcacattgtggccagctgataaatgcttgttcataatattactaagtttctggattgttttacagtccctggagatcaaggaagaataaaacaagaaggaagaatcattaagtgactaaaatgaaaaaaatcaaagaagaatcttgaaatatgagtgtggcagaggctgcaagttgcctaattattttcatccctacctctttaatccttagaaacagaatttctacatcactggcaaacatgtgccaggagctaggctaggccgccctttaagagggaaagcagtgaagcactagaataacacccaggggagtgttctccaaaccctcctacctcttattccaagcaaagcagagagcgcttagggaaagcaatactaggaatggctgctcaaagaatttactctgtatgccacactctcacaagaaattaggggatgttttagtccgttcatgttgctataacgaaatatcatagactgagtcacttataaataacagaaatttatttcccagagctctggaggctgaagtctaagatcagggttccagcacagtcagattctgctgaggaccctcttctgggatatggactgccatcttctcactgtatcttcacgtggcagaaaagaaagtgagaaagctctctggggtctgttttataagagcactaatcccattcatgagggctccacccctatgatctaaatacctcccaaaggttccaacagtcccacttccttacaccatcacattgagggttatgatttcaacatataaattttggggagattcacattcagtctataacacgggtcccattacttttctactgagattgtttcctcagctttagtattggtaacattctgaattttatggaactactacaaggagtaaacaaaataaatgtaaccaaagtgcgtatcagactgcacaatccagaggcaacccacaaggtattaaccatgatttagtttgttcatagcacgtttcagtggaagatctctcaactcctcacaaaccccaaaccttaaaccatcccgtcatattcaattagggaaactctaagaggtattacagttttcctggcaactgacaccagatgtcacctcttccctcccctgcttccaccctcaaaatttgtaatttcacatgaaacagtattcaagaaaaaaactataaatggaaccaaggtacaaagaattataattatattgcccctgccgggcacggtggctcatgcctgtaatcccagcactttgggaggctgaggtgggcggatcacctgaggtcaggagttcgagaccagcctggccaacatggtgaaaccccatctctactaaaaactacaaaaattagctgagcatggtagcaggtgcctgtaatcccagctacttgggaggctgaggcaggagaatagcttgaacccaggaggtggaggttgcagtgagccgagattgagccactgcactccagcctaggtgacacagcaagactccgtctcaaaaaaaaaaaaagaattatattgcccctagttaaaaccaagacagttcactaatacaaaacggcatcagattgctccaaagtaggcttcctcagccttggtactattgacatttggcgctagttattgcttctgtgcactgtaggatgttgaagcagtatccctggcctctaccctgtagatgcagtagcactctcccagttttgacaaccaaaaataagtctagattgtgaactgtcccctatggggacaacatccccacccccacctccccttaagaaccactgctatttgaacaccactgaaatgaaaaccccaactttaaagtctaaagctcttgagtttggcttctctcataaatgaagaaaataacatcctcagaaataagaactgtttcccaatggctttcaggcattaaaggaaaagtattaactttctgttgttgttgttgctgctgttgtttggaacagggtctcactctgctgaccaggctggagtgcagtggtggaatcttggctcactgcagcctctgcctcccgggctccattaatcttcccacctcagcctcctgaagctgggactacaggcatgagccatcatcccaactatttttattttttgtagagacaggggtttcgccgtgttgcccaggttggtcttgaactcctgggctcaagtgatccgcctgccttggcctcccaaaatgctgggattataggcgtgagccaccatacccagccttagctttcttagaaaatgccattttccttcctgacctgtgaccaggagctttaccacacagcatgttgctatatgcacagcacagtctgagagaagtgttactttaatggctaatataataccatttgcagaaaaaaaaaaaacacatacaaaaccaccaaaaggagaaatcctgacattagtgaaatattcagttgtaaaccaaaagaattccttactgagagtgattggctttcacatgctttgcccagtaatgagcaaatgatatctgaagacgttttatctgtgctctggagaactactatcttttagtagcctcaaacagacagttgatcattctgggatttggacatgattttcttggtctcccagccccattacccgggggccagaaaaaacatttggcatgatcccgactctaatataaaagggttggctccctttttggtttctaactaccactgttaaatatgaggtcaaagttctaatgattactgtcactttctgattttacagttaagtatatcatacagaatgttagcaagtgcctcactttcctcatccataaaggcagataatagcacctacaccctagagggttgttatgcagatcaaattttattttgaggatcagtatttgtaaaatgcgaccaggtgcggtggctcacccctataatccctacactttagtaggaggccaaaccagacagataacaagaggttgggagttcgagaccagcctggccaatagggtgaaaccccatctctactaaaaatacaaaaatgagctgggcgtggtggtgtgcacctgtaatcccatctactcgggaggctgaggcaagagaatcccttgaactcgggaggtggaggttgcagtgagccgagatcatgccactgcactccagcctgggtggtggagggagactctgtctcaaaagaaaacaaatttgtaaaatgttcacaatactgtttatatatagcaagtggtatataagtgcttgttaaacaaatacaatctatataactcttgttatttgatggagaaattataatgtttacagttgcattcgtcgtgccagattggctgtatttttgttttgttctgtgtttcttttgctgggagaagatggagaaacattctttgaaaatgtccctttttctctctgaaccttcactcatgccctagaaaaaagaaaatcatctcagggccaggcacagtggctcacacctgtaatcccagcactttgggaggccaaggtgggcagatcacgaggtcaggagtttgagaccagcctggccaacatcgtgaaaccctgtctctactaaaaatacaaaaaattagctgggcgtggtggcaggcgcctgtaatcccggctagtcgggaggctgaggcaggagaatcgcttgaacccgggaggcggagcttgcagtgagccaagatcatcactgcactccagcccaggtgacagtgcgagactccatctcaaaaaaaaaaaaaacttctcaggaaacaataccctactatatgtgatgcactaattgtgtgtgtgattgtgtgtgtgtgtgtgtatatatatatgtgtgtatatagattctggtttgtaatccacagtacagatttcactacagtcactaatcttgtcctacaatttgaaaaacactgctttagatgagtattccaagaagaatattctgtagagaagcagtatcacaacatattaaagagtttcatgttcaagaaagtttgagaaagccttactttgtacaccttaacaacagtacaagtcattagatatcctgcaattaagaaatatattcattctacagaactcaaaacttatttgtgaactgggcattgttttcctccactgtgacagggcagcatcatatagcttgtgggccaattttcatatttctcaaatgaaaaaagttgagttccaggaaaaaaacattctttctgactgaatctaaaagtgcctaactctgtgcctaactcaagtagctgtttaagaatcctggttcaactccattaagcagttttgccatttcttagtaaaatttaataaaaagtgaccctggattatttttcccttaaaagggaatgttacttgttaagcaggcaagatagcagaaattgaaagtgctcagctaggtgcaatggctcaggcctgtaatcccagccctttggaaggcagaggcaggacagcttgagcccaggagttcaagaccagcctgggcaacatagcgagactctatctctacaaaaaataaaaataaaaaaatgagatggatgtggggtacgtgcctgtagtcctagctgctcgagaggctgaggttggaggatagtttgagcccaggaagttgaagatgcagtaagacatgctcatagcactgcactccagcctgggcaacagagcaagaccctatctcaagggaaaaaaaaataaagtgctatttaaatgctaatagctttccaatgcctttttttgagaaaaagaactaaggaaaggaagagcaaaagagagaaagaacagaaggaaggaaaaggaagggacggagggagggagccatgaagggagtcctttggatattagatctcctgtgtgcaagaaacttctagaagtatgaccagctcaccaaggaaatagctaaaaaataaaacaaagatatatgtctaaatttcatactctttgcagcattacagaataagggaagatagttggggtagagaggtggataacccaacaatagggaaatggttaggtaataaagagagtgtcaattttgtccgacagcattaaaatataacaaccaggcaaatattcattatgtaatattagcattcattcattatattgaggatatccattacataatattgctgtgatggggcatgaaatagaggacgggaaccaaattcatccatcacgttacaacatatatgaaaagcaacaaggaaattggaaacaagtggtgtgtccgtagggcaagagtgctcaaatctgggagcaccaatggatctggtggggaagccctttttaaaatgcagagtctgtgggctctctcccaaacatcctgattttgaagggccagggtggactcaagaaactgcatttggtttttttgttgttgtttttaacttttactttaggttcagggatacatgtgcaggtttgttatatggataaactcgtgtcatgagggtttgatgtacagattatttcatcacccaggtactaaacttagtacccaatagttattttgtaatgaccacctaggagattctgaggctgatgatctggggaccacacattcatttcatgaaaacttaatgggtatgtagtatctgctgtgaaagcaaactaagtatagcctgagaaggactctgtacttttatatttgagtccttgtggaccaaccttgtctaataggtagacaagggtgaaaaactaatttaggagtatgcagctgtaacaatagctgagtcttggccaatcccagtagccatgcttcaaccagtcatacactgctgagtgttcaactcttttccaaataaggcaaatgccaaggtgtaacccatccagctatttctgtatctcacttccgatttctgtatgtcatttctcttttcttgcctataaatttattctgaccacagggcatccctggagtctctgtgaatctgctgtgattctggggactacccaattcgtgaatcattcgttgctcacttaaacttctttaaatttaatttggctgaagttgttcttctaacactgccaatccctgttctaggtgctagagacagagcagtggctaaaggcacacttgagaggcaagcaataaagtggtaatcattcttttaaaaatctttagtattaaaatagtatttattaaataaattccctgaaaaaaaatcaagagccaacattttcctgctctctaatttatgttttacttaagaggaaatgcaccttagaaagctctctgggcctggccctagggtccgcctacagcatggacactggaagggggtggccaccgagggtatctgtccaagtgaggtcctggcacttcctgccattcctgcatgccctcccagggcactaagggtgatgactgggaattagaaagggtggtgatgaagaaggaataaaaaatgtgttacttcaactcacaagaaacacaagttaaagaactttcgggaactacaagtcctcgtcagcgtcttgtgggctattgacgctgacctcccaacttggtgccagttagaatttcctccctgccttttctgcatttcatcatttatttcctggtttggaatattaaaactttgcttacatcctgttttggtccctttggtttttttttccgttgggcagaaatttcagcaacctcctccaggttagagaaaagcagagccaagggtggcaatgactttcagcatggacgagaacagccaccaagaggggagagctcaaacctatttgtcttggcaatggcattcagtgagctgctggttatgtcatctgcctacaagtaggcctcactgttttgcagtcatccatttcccaataatggtatcctgacaccacacacgcacacccagatctggcagcgcacccaccagcctgcgctgactccagaagaggtagggccagggacaagaaaacgaaaaacaatccacatgaaacagatcacttaagaatgttaaatattaaaaatgctgttttcacctgcagagtaagaaaatataggaaaaagtggatagctggagaattttatgcagctaatgagtttatacagtttaaaagcacacttttgaactaaaatctaaagtgacaaaatcatgaaagctaagcagtatgcaaaactctacaactgaagtgtttcacctcagtattttatatgaattaatttcaatttacagctaaatgtcaaggcaaatttgtttcttttctatcttgtgttatgtttggtaccctaaggcttttagacactgaataacttataaacaaataacatctcatcctcattgttatgtaaaataactcccgagcttgtgtttcctgtagttcttcaaggaaagaggatcctaatgttgaaagaaaattgtattggtaagccatagcaaatggttcctaaaagcagactaacaaaatgctaagataataggcccctatcattttatatttatggttttatctatagtaattctgggattagaatttgtaataccccaaacagcatatgtaaggtataaatatctcctaaatatatttaaaacctggaaaaattatacaatcaacctaaaatggaggaacacaaagaataatacaacatgtctctaaattctgacataaatttaagggatgaaaactcctatatttatatttttaaatcatcaaatgaatacactgagataagctataataaaattattatgctcaatttacactaattataaattgtacgtttctgattaactgttgaggctttcaagtgaaagctttaatcagcaatatcagttttttggtttgtttttctgagacggggtctcggtctgttacccagactggagtacagaagtgcaatcacagctcactgcagcttggatctcctaggctcaagcgagcctcccacatcagcctcctgagtagctggtaccacaggcatgcaccatcatgcccagctaatttattttatttttagtattgatgagatctcactatgttacccaggctggtcccaaaccctgagctcaagcaatcttcctgcctcagcctcccaaagtgctgggattacaggcattgagcaactgctgtgcccagcaatcagcaatatctttctctttttttttttttttttttttgagacagagtctcactctgtcacccaggctagagtgcactggtacgatcttggctcactgctacctccgcctcccaggttcaagcgattgtcctgcctcagcctcctgagtagctgggattacaggcacatgccaccacaccaggctaatttttttgtatttttagtagagacggggtttcaccatgttggccaggctggtctcaaactcctaaccttaagtgatcagcccacctcagcctcccaaagggctgggattacaggcatgagccactgcacccagcctggcagtatctttttaaaaataattgctgctagcagcaatggacactctgccctggaatattataagatatatctccagccttcctaaatgactcccttgtttcataaaaccccaaattttctgccttttctttgagactttcttcattaatgaaagttctctttattgcaatagcctaaataaaaaacccaatacatgtgcccttttattatactaaaacccaaatggttcaagtagagcttatggtaacttttaaatgagattaaaaatcacttggccggcctcatgaaattacagtttgagttaggcccagaagcctgaaaattttggaaagttcagtagggttaacccaaaaaacatctaaatccaggtttaaatttgggaaatcttttctttaaaagagaaggacacaattcaaactggctcaacttattcaacatacttataaaacaaatcactaagtctcaaatgagtacatctatctttgacccacagacttaaaaagctatatatgccaagaaataatatttaagcaactgttaaaatctgttaggattttagaatcgtaaaatcctttggcagtcaacccattctacagggcacgaagacgatgctgcagatacctatccatgaattatgcagttcaattttatgtccctaagccaaacaactgaattgaattctccacagtctcttccaactgcccagtaaccagcctaagaaaggtgacaagagcaaagcaaatgcagcacagagaaaaagacaggcaaagatggcagctgtcatttcttcacattgtgctgtcagacactctatattcctcaaagcatttgtcacctccggagcacacttccattgctgccaacatgacatttggctataaatttttattcactccacttattaaaatgcaaggcccttggtccagagcacgtgtcatatcagaaaccttcccatcacctgcataataaacctgtgcaagctgtgtccaacatttgtgtccctatattctagaataatgcttaacacagagtaaccacccactaaacattgttggacgaggtgttaaaggtcaattgctatttctgttgttattactactagctggctggaaattgctaagttcctgttaggtgcagacttaagaaaacaaaacagaattcactgacaaatgttatcttctgtctcaatcgtcatttagacttgaccaagtttactgcttcattttaccaagactacaatccctcaaaagaaggaaatgtactttttattgttggtcacaagccctagcacagtataatattcaacatgtccagcattcagctgaagtatgagacatgcctccaagtttctaaggctgaaaagagttcaactttctctccaaagtgctaagatataccacaagtgctacatggggagagtctacttactggtaggatctaaacttaaacctccacatctatctaaattcccaagtttttaaactttcctatctagggaaaaaagtttcttttacttttatatcttggctccagttttatatttaaactagattggggctgggcacggtggcacatgcctgtaatcccagctcaagagtttgagaccagcctgcgcaacatggcgaaaccctgcctctgcaaaaaatacataaattagccgggcagagtggcatgtgcctatattcccagctactcaggaggctgagatgggaggatgacttgagcccaggatggggaggctgcagtgagccgagatggcaccactgcactccagcctgggcaacagagccagatcatcaaaaaaaaaaaaaacaaaaaaacaaaaaaaaaacaaaaaaaaaaacaaacaaaaaaaaaaaacagaactagcaatattactgttttttttttttttactttacagcttgtcaattttaatcaaaagaaacgaaaagccacattcagtattaaagttaaacaagttaggagatgaaagtagactagaccacccaagtgggtaacttagcactggctgaaattacctagctttagttcagagaccactcctgaaaaggaaaagacatttctaacaactttagccaaagatctgggttctttgaagcctcaaagaaccctcctggtaagggtactctgcatagatctgcatattctcccatggccccaaaagactaaaagcccaggcttgtaccccgccctcgctgttgaaggatcctcagagaaagtatgttgagaatccatgaaaaactaatttaaaagattaaaatgtgccctgcagctcaccctctctagaaaacactacaggagaaaaacaaacaaagaatataagcaaagtactaaaaatccctatgtaaattaaactctgttgttataccaaagattgctcaaaggaaaaaaaattatcatctttccaagaatttgtaaatccctcttcaactggttggaacggaaattacaaaatgctaccccccactggtcggcaaaagccaccacttaaatggaaaagcttcccttgaatcaaatgaagtcccagacagaggtatgcactgtgtgctgtcactaccaacatgaggacctactcagggacagatagagtgcagggatacctcagggcaggggtgtccattcttttggcttccctgggccacattaaaagaattgtcttggaccgcacataaaatacactaggaacaatgatagttggtgagaagaaagagaaggaaggaaggaaggaaggaaggaaggaaggaaggaaggaaggaaggaaggaaggaaggaaggaaggaaggaaggaaaggagggagggagggaggaaggtgggagggaaagaaaagaaaagagagagggaaagagagagaatctcataatgttttaagaaagttcatgaatgtatgaatttatgttgggccgcattcaaagcatccattcaatcactgttttctcctcccagagaattctgcatgtagtcaggctctggagctgcatggtccaatatggtaacccccagcagaccctgaggacttgtcatatacctcacatggctgaagaattgaatttctcgttttatttcatcttcaatgattcaaattgaaaatactcaatgctgttagtggaaaacatttcattgtgtttggaaccacctgaatctactttttcagtgaaattttgttaaacgtaaaaacagatcaaatgtttccaatgaaactgttgcatcgaaatggagatatactctgaagtataaattacgcatctgattcaaagacagtatgaaaaacacgtcaaatatctcacaagtaacttttattattgactacctgttgaaatattattttaaatatatctaattgaataaaatgtattattaaaattaatttcacttcttttttactctttttaaagtagctaccagacaattttaaattacaagtggttcgcattatatttctattggacagaacagctctagagattccaatcagcttaagccttcaactttaaaactccttaatcatttttacgcatggagttctttggcagtctggtgatgactattattacctcagaataatgtttataaatgaataaaatatgtaagagtccaaaggaacctaattatactgaactgtagtgagcaaaatattcttaaataatcatgctttttcttaaggcactgaagaacaataaataaataatggtgaatctattagctactgtagtgataagagtaaatgagattgcaatgtgatattaaaatatctgagattcctactgacgacaaagtcataagtattgcttctgtcactgtggtttgttgcctacattcataattcaaggaaatgctcaaattcagttaggggttagtgaaagtgtagatagataactcttagcccacccaaatttgcagatcccctatttctctgacagactttttggggacccgtggattccaaggttaagaatgctgttttaatgcctgatgaatctgtgtgtctgtttgtcaaagatgacccccatccttaggatgtaattttgccttggctcattcctgtcaatttggtgttcatgactcataattcctgtttttgaccacaactaaaccaatattagaaggaagtgcttgcacttgtttttttccgatacttttgctctgcaaagggaacaggaagaacagcaaggagtgtatatttaaaagaaaagagcaccttaactacgtaccaaaacacaattcttttgatctaatgattaatttgtgtgtgttagaatatttaccaaccagaaagaccacataaggccgggcacggtggctcgcgcctgtaatcccaacactttgggaggccgaggcgggtggatcacgagatcaggagatcaagatcatcctggctaaaacagtaaaaccccatctctactaaagatacaaaaaattagccaagcgtggtggcgggcgcctgtagtcccagctactcgggaggctgaggcaggagaatggcgtgaacccaggaggtggagcttgcagtgagccaagatcatgccactgcactccagcctcggcgacagagcgagacttcatctcaaaaacaaacaaacaacaacaaaaagccacataaatatcactggcacttcatataattaactgtacaaagtatttcctgttgtttgtcttgacaaacactttcataacacttaccatgtgcagatactgttctaaggactacaaatactaactctgcaatccctaatacaacctatgagtcaagtactattattatcccccttttacagatgagacaactgaggctcagggaaaggttaagtaatttgcccaaggtcacagaattggaattccaacagagagcagctgcctatggtgttctcaaagggagggcaatgccaaacgaaaacaagcaacaagactctactcattgcaagtgagcaaaggttctgatcaaatcttcattcttgcttccaaatcacttgctgaaaaattaaaactagataagtaaggacagctgcctttataccttctggcctattcacaggcagatttccagacgaaaccaaaggccttcatgaggaaaaacaaagctcctcagtctcagggcagctaatgctgggcctggcattttttccactcttatctaaaatatgctacaggagaatctaggcccagtgataagccaggtttcaacttcacctccccagcctgagagcgattacacacatacttgggatttaaccagcaagagaaggacacggaaacctgggtccctccgagcccagtttctgttgacactgttgccagggctgagccaattgcaccagtgtcaagagctccacagggaggtttcagcagggaaaccagccctacaggtgtatccagggaggcaggtgtacaaggccacattctttcctccactgaacaaatcaaggtttgtctccctgctgtgcggggctcacagggccagataaatctctctcagacaacaacctcagcacagaaacagtgtagcttgctgccactctgtagcaccgaaagtaaaatgccaaccactgaaagagagaagcagataatgttacaataacatttatctagaaaggcaatgttcgttaggtaaaatttaactatggcaaaaatctttaggacagatagactcaataaatgtttgtggaactgaaaacctagtgctaccttttaaaaggtttcttggactaatttaaaagcttcatttggctgtgtgaactggcattccctttctaaaatgatagagtcccagtggtagctataatgttaaataaaatgacttcatttcctccagaggaatatttttaccccaaccccccatactccggcactcaactactcaagactccaacatcagggggcaaaaagtcaggcctattaggcctggatcgttctcagattaacaaccttgggggaataatcctataagaaaatattttcaagattttgggtaataacatttttgggccagatgaaatttgttagagtttgcacttctgtttctaaaaacctctgaagccatttgtttcccacagtttttttcagaagctattttgtgggaaagaaagccagggcctaggcagcaggccagctagaacggggttgctctgaaagaaagccagccccggcaagcaggagcgacatgggcagcgcttgccaaggtggttaattttttacctgggtagagccataggcactgacatagaaaatgtctgtgacacggcggatccggaaacaggcaagatgcacaggcagtggagtgtctgaccccaggtttgttgctacaaattacaaaggaagttatgccaaactgaaatagttatctacagagagaaggaggaggggcggggtgtgttgtcaggcggcacggcggggaaatggcagtgctgcgacagaggacctcgactctggactacacagcctcgcactccaatctcagttctgccacttgttgctggaggaatcttaagtcaagtttcttaaacactctctgcctcagtttcttcacctataaaccacaggccccaacccccagggctgctgggatatataccaagcaggtactcagaacagtgcctggcactgaggaagtgccaggtaagggcagctgttgctatttgtgcaaattctgacatttgtcattctgaacataaccctcataacaaaagaggtacaactgttacctccactgagagatgaaagaattgagacttagaaaaatgaaggaatttgctcaaaatcatgcagttagcaaaagactacctgtttgtgaaatcagagcccagcagttttaacctctctcatctggtctttcttcccttacttaacttcccgaaagagagagacagagacagaaagagagaatgagagatggggagaaacacagagacagggaggaggggggaagcgaagaaaacacgttagaggtaaataactttttaagctaataaaaaataaccttggccaggtgtggtggctgacgcctgtaatcccaaaactttgggaggccaaagcaggaggatcacttgagcccagcagttcagggccagcctggacaacactgcctcttaaaactaaataaataaataaacgtaattaattgcaaatgaaattccaccaggccaaactctcagtggctacatagtaagtggttacacctctcctagcctcctagaccagttgcaccttgattctagctgagtttcactaagcagggcaaatgaagcaggagaaggctcggagggaacccacctgaaatgaagctcagctgtctttgaagagtctatctattctaaggctcaggagtggtggcatgatgaatatcgctgctaggagaagaaatgcaaaaccatataacatttttgcctttccatccttgaaatgccttacaatttcccttggaaaaaaaaaattgtcttgtaattcttatttttctttacttcactttttcatttccagaactgctatggttctggctgaagtatcagaatgacaaccatggatcttctacaatgccaccatcagtctctcagcaattgtagcaaagggaaaaacaacaccactgaggccgccagtcacaatatttacccatgccagagtgttctgtttgttttcggtggaggatgcagagagtagataaacgaaaagcaaaacttctctgtgtcaaaacacaagctgaagatgatttccttctccactgcccatgtatgaaatatacacaaatccagggcagccctgggccgaaggagtgtttatggttctgcccggccataaacatgccagccttcaaaacaccaggacatcaaacaaacaaggcagttccagaaaggatatatcgacttttgacgtctaatgctctgggtgaaataactttgtttcccctaaaaatagataaactaaaataaatataagagtattctacagcaatgtagctagccgcatcttcctgtgactcactgtttgataataactatgggccaggaactaagtgctttttggtggaatgactgatgctcttcataccaactcggtgaggaatttaaaatgacatccctttgcagataaggagactgagtctcaaagaggtaaataactatgtaggtttacatagcctgccaccggcatttggaccttggtgtgtgagattctgtagggtgaagtctaacaaaatggccccaccttcagttaaggattcaaatgatcacctagtagcccttcaaccagggttaaagctaaactcattcagagtttctggctctaaacctcactctcatttctttacagtgaaacacagaaatttaaaaaattcaaagtaggcatactttcaggtggctaaaattaaaagatcatcaataccaagcgccgacaaggacgttaaataatggaaacccatagactactcgtggtaacataaactagaagagctggaacactgcttaaaattacctattgaaggcagggcatggtggctcacacctgtaatctcagcacttcaggaggctgaggcgggaggaccacttgaggtcagaagttcaagaacagcctggccaacatgatgagaccccatctctatataaaaaatgcaaaaaaattagcctggcatggtggcacacacctgtaatcccagctacttgggtggctgagacaggagaatcacttgaaccgtggagggagaagctgcagtgagccaagatcacgtcactgcactccagcctgggtgacagagtgagaatccttctcaaaaaaaattatgttattgggattagaaaaatgcatagtctaacccaatcctacaagtccactctgaggcataccctagagaaatgaaaatacatatataccaaaaggcataatgacagtataataatttgtaatagtccaaactacaagcaacacaaatctcatcaaaagtaggacacatgagtaaatgtagatatatgcatgctatagtattatacagaagtcaaaatgggctgggcacactagctcacatctataatacagtactttgggaggcgtcgatgggtagatcacttgaggccaggagttcaagacctgcctggataacatggcaaaaccctgtctctacaaaaaaaaaaaaaaaaaaaatttagctgaggatggtggcacatgcctgtagtcccagctacccgcggcgctgaggtgggaagatcgcttgagcctgggaggtggaggctgcaataagccatgattgcaccaatgcactctagccttggccacagagcaagacttcatctcaaaaaaaaaaaaaagaaaaagaaaagaaaaaggaatgaactacagctacatgcgacatggacaaatctcaatacaatgttgaggaaatgaagtcaggtataaaagaatccatactgagtgaatctatctgtacaaagttccaaaacaagaaaatgggaatagaggtcaggacaatggttaccagggagcgagcctacccgggggcttcctggttgctattatgttttagttctttgttgttgttgttgttgttttgttttgttttgggatggagttttgctcttgttgcccaagctggagtacagtggtatgatcttggctcattgcaacctctgcctcccaggttcaagtgattctcctgcctcagcctcccaagtagctgagattacatgcatgcagcaccacgcgcagctaattttgtagaaagggggtttcaccatgttgttcaggctggtctctaactcttgacctcaggtgatacacccgcctcagcctcccaaagtgctggaattacaggtgtgagccaccgcgcctggcctagttcttgattgaactgttgtaacccatatggactgactttgtggtaactcatccactgcgatttatgcccttctcaatcaaatgacctccctctccttccctcttcctccctcttaaaacaaaaaagtagggacattcataaaaccttcaagtctaaatcaagtttttgagacttacacaggaaaaaataggtacagtgtaagacattctaaatttagctcaatattcttaacatgcaggaacaactctatggagaaatcccttcaccctccaatgttcaactcagcaacattttaaactctgttcacatccaataaagacctgcttattgtatcatcaaaaaggtatgcatgcaatccatctcaagaagaggcttacctgcacagtgactagggtttactgcaatgacaaagtcatttcatgccttgaccgaaaatagccttagactgggtaaaaactgggcattctctgcagtggttcctaagagaagctgaggttagtgtggaattaaatatccttatctgcatgggtagacttaacttccaaaagtcgtacagaagacaacagagttccgggtaatatggcccatatatcggaggtttaaagctgatgcccatggtgcttgtgagcaaaaatacacatttagccaggcgggggagctcaggcctataatcccagcactttgggaggtcaaagcaggaggatcacttgaggccaagagttcgagaccagcctagccaacatggtgaaaccctgtctatattaaaaatacaaaaattagctgggcacagtggcgtgtgcctgtaatcccagctcctggggaggttgaggcacgagaatcgtttgaaccccgaaggcagaggatacagtgagctgagatcgtgccactgcactccagcttggccaactgagtgagactgtaactcaaaaaaaaaaaacaacaaaaaaaaccacattttgccccttgtccagagtagaaagaattgtggtgcttcttacaactgccaaagccaaagcctgaatgagttctaaaagtctctggaagtttctgagggcacagtcactccaaaagatacaaatcctgggactctgaactagctttgtttgacagccccttcctttggttaaattccaaaaatatctcaggctcacctcaagcttactgcattcaaacgttctctgatttctccttcctctctactgcatcctttgtcttctactcccttaagacattattcctttcctacttgccctttactcaagttgtctttatcctcttagctatacaatgatttaattcagtacaaagaacatcactattctacccatcactgattccccagggcaaggcactatgtctgtgcacagtaagtgagtgatgctctttttgttattttggtttttccttttttgagacagggtctggagtgcagtggtgtgatcatagctcagtgtagcctctacttcctgggttcaagatcctcccaccttagcctactaagtagctgggactacagacatgggccaccatcccagcatttttattattattattattattattattattattattattattattattgagacaaggtctccctatgtttcccaggctggtctcaaactcctggactcaagtgatcctcccatctcagcctcccaaagtgctgggattacaggtgtaaggcaccacgcccatcctaatgtcttaatggacaaataaataaattctctctttttttttttttttttttttttttgagacagagtctcactctgtcgcccaggctggagtgcagtggcgcaaactcggctcactgcaagctccacctcccgggttcacaccattctcctgcctcagcctccagagtagctgtgattacaggagcccgccatcacgcccagctaatttttttgtattttttagtagagacagggttttaccgtgttagccaggatggtctcgacctcctgacctcatgatccgcctgcctcagcctcccaaagagttgagattacaggtgtgagccaccgcgcccggccaataaattctcttttaatactagcaacaacagagacaagtatctttctgttcttgtcaaaccaatgactgcagctctgtatgtttccggagtgatttaaacttgccagatgagcttttagccagtcaaactgattttcctttgagcctagattcctcatgtggaaaagctcccagaaaagcttgactagataagaaaaaagtgatgtctagacaattctgcgttagccttctgctgggaaaacctccagctgtttcactgaacctcatacaaccaaatcatagttcacatttcacagattcctcaccagggttttgacatcttgggggaaaagaactgaagaagggtgggcaagacatctgactatagggcggtttctaataaagcaataagtacaaacaattccaagaaaactaggatgtcactggtccctgtggtcaccaaacaagaaggatgtctgtcctatgtaaggacactgaagaggggaaaaagtgcgtaatcctaatttaattataatattttttcctataatcagagaggagaaagtcacccaagcttgaagccaaaattataaatttcattgtccacacaaattgtacaagatttcccttgagcagactgcagggaggtgggctcttgttatccttccttcctttcaactcttccatttctgtctgtaatttccccacctttgtttccatataacttcaccatccttgctcctatatggccacaaagaaaattctgagaaaagagttgaaataccccagttaaatagattccttccttgtctattaagaagacatcactcttatttactttctgtaccttggctctaagctataagttcatctgtcttttctatgctataggcagtacagagcatgggccagcctgaaatggcaggcctgcaaaaattgatatgccaaatgagaaataagaaaacttgctttcaactaacatgaaatcccggaataacctttgaatttccatgacaccattcatctagggataagaggggaaggcagaagggggcattcctgtgtccatttggtgtacccctgcaacaggctattaccacttactgcaatgcattaaaggtaggacagacagctaggaaacgaactggtctctgtccagtcgaagaattagtcaacacaaatctacagaagtcaccttgagcttggtactatctacccataatgcatttcccctcacctctttaaattcattcagttattcagcccctcccttcctgggtggtaactacaactgttattttcaactccagttccttatgcaacactgcaaaatgcataactgaactgtacactgttaactaaatagatgatcagtataataaagagtcctcatgtaaattaaggaaaacatgtaaaaaccccccaaaaatccactgaaaaatcatttgtgcattcaacatagaaagacccttaaatatgctatgcagggtatcttagaaaataatattaaaatgaagccctcttggagaaactaatgacttgtttttaaaggtctagtgagtgcctagatagtgccttactaaggcattccgcagaaaacagggttccttgtattcagcgcagtcaggaggtgaactgatatcaaagaaccacatccattcgtgtcattttacacgtttcaagaaacaaactttccaataaagacagactccattcctcttcccccaaccttcctgtcaggcttcccttaataaagtttctgccagataaacatcatgaatgttccattgtgctgagaagaaagaagtttacagcaaattgcttggttagagctaagagtctgggagccacctgagcaaatcagctaagtgctttggaaaaagctatttccaaattgggacagcttccatgaagtgactgggcatagtcttcatgaagaggttgtttgtctcctcctatccgtcatatcagtagtttcaagataagaagaaagcatatttggactgtttgttctcatggacattaatctgattgtattttttttttttttttttttgacggagtctctctctgtcgcccaggctggagtgcagtggtgcgatctccgttcactgcaagctctgcagtggttcacgccattctcctactcagcctcctgagtagctgggactacaggcacccgccaccatgcccggctaatttttttttgtatttttagtagagacggggtttcaccatgttagccaggatggtcttgatctcctgatctcgtgatccacccgcctcggcctcccaaagtgctaggattacaggcgtgagccaccgcgcccggcctctgaattgtatttttcaagtgtactaaagttcctccaggaactacacacacaacaaatgtactttccaacttgcttatttaggaagatcagctttgttacatcaaaacgtccattagaaagtcatgacactggccaggcgaggtggttcacgtctgtaattacagcacttcgggaggctgaggtgggaagactgcttgaggtcaggagttcaagaccagcctggccaacatggtgaaacccaatatctactaaaaacgctgggcgtggtggcccacatctgtaatcccagctactcaggaggttgagacacaagaaacacttgaacatgggaggcagaggttgcagtgagcagagatcatgccactgtattccagcctgggcaacagagcgagactctgtctcggggggaaaaaaaaaaaaaaaaagaagcagaagaaaaagaagaagaagaggagaaaagaaaaagaaagtcacaaaaaaatgagcagagaaattaggttttacctcaagtgtcagcaaaaaaaaaaaaaaagttaaaacaagatgagtttttttttttaaacactgcatataaaacaatgaagtaatttgttcagagagttctgctgttaaaataatgacaatctggccaggcgcagtggctcacgtctgtaaccctagcactttgggaggccaaggcagatggattgcctgagcttaggagttcgaaaacagcctggccaacacagtggggaaaaaaaaaaaaaattagctgggagtggcatttgtagtcccagctactgggaaggctgaagcagaagaattgcttgaacccgggaggtggaggttgcagtgagtcgagagcgcaccactgcactccagcctggtcaacagagcgagactctgtctcttaaaaaaaaaaaaaaagtagctcggccaggtgtggtggctcacgcctgtaatcccaccactttgggaggccaaggtgggtggatcacaaggtcaagagatccagaccatcctggccaacatggtgaaaccccgtctctactaaaaacacaaaaattcgctgggcatggtgtcatgcgcctatagtcccagctactcaggaagctgaggcaggagaatcacttgaacccagaaggcggaggttgtagtgagccaagatcgcgccactgtactccagcctaggtgacaaagcgagactcagtctctaaataaataaataaataaaaataatgacaatgtaatgtaggatgggcagtttgtaacttttctataataattcttatatgattttaaaagggccctatgcgaactactttaacatgcactattttacttgaaatcgcacaacactcccaaaacaggagaaaaatttcataaagacagagagctttgcttgttgtatacatttatttatttcaagatttggcacaatgccagggatagagtggtacttaatgatatctgtggactgaaggtcaacactttttcatatattagacaaatacagctcataatgattaagaaatttgtctgagaccacaaggctgggaaatgactaagccaagcttccaatgaagggcagtgagtcagattcctgagtctagttcatctaatataattgttaagggtgttaacattaatctttactgcatcacatttctgcaaggaagctttgagccaccatcctgaagactgagaaaccaacacaattttaacccattaagcacagcaactgccctgccctgtctttcaatatcctgtccctgtctcattcacagtgtacctctgcccccagtaattaccttagcgtcagagatccacaaacaaaaacaatgttaagacttgagagaagccaaaccactcacctgctgaggtatggcagccctaactgtgggagtatcacctccctactgatatcaaaatcagaccctacaaaggagaaagaaaggtcatctgaaatcaccttgacactccaaacagggacttatatctgtgggtcagagagtgaatgagtcatagagagaagaacacttcatagaacagggcatgagtcactggttcctttcttattgagatagaaagaaaggtatatccttttatacatcttgggggtagtgcgggggcggggggaaccaccatctctttcatttgctcccattctcatagctccatgaactgtccacaagttatcaccggtgagtatgtggttctcttttcaaggcagggctatcgcccttaacttccactcctctccaaacttcaggttgtttagcactaactccactcagacagattttttgagcagctgcacacctttgtctccctgaccagaatccccaggaatcatgcaaatcctcaggcatatcctaggttcactttcaggggattccctgaggatgccccttttttatgttcaacagccttaggaagccacccccaagtccaacagatacacagtcccctttttgtggatgtccaggccacacaagaaatggaaagaatttcaataagaaactctcccggaaactatatgcatatgcatatctacttctaggtactgatgatgccaaggactctttcataaagacaagcacattcgccaaagccccaaggcataattagccttgctctaaaactttcctaagtggccagaatctactgcatatatttttcttagccaagaaacagatgtagagtataaatggttttccactgagtaccttcaaaacagatgcaactatttggtaaatgttccatctgcccagagtatccattgtcaatggagaccagacatacaaactccgaggatcatttaattcagtgttcaaaagaacttccatcatttgcatcccagcctcctgacttttgccacatatgggtaccacttctactattccacgttaccctttttaaaaccactttattttcatgtaattaaatatattttaaatggaaacttcatatcacctctaggaatagacatgcagaaccagctgccataaaaatgaagtaactaaaagcaaatacattgaaagcaaaatcttgccattaaaaggtatggtctctcaattaggaaggaaaattagcaaatgttagggggtgctgaagacatattaacacctgatagagacttacttgatgtaatctcaagaactgagaaaggattaatggaagaggaggaaaggaatgaatttgaactgaagcaggaactcaagtgagaagacaaaatctgaggactctgtttcaccctttttttttttctttttggttttgtttgtttgtttttgagacggagtcttactcggtcgcccagcctggagtgcagtggctcacttcaacctccatctcccaagttcaagcaacactcctgcttcagtctgcctagtagaatgcaccaccatgcccagctaatattctgtatttttaagagatgggatttcgccatgttggctgggctggtctcgaactctgacctcaagtgatccgcctgcctccacctcccaaagtgctgggattacagatgtgagccatcacgccccaccagtcaccctcctctttatactgcttactatgggttacttctcagagatagaagacggtatcaatgccacaatctagggtaaatgaccaactggagtgtggtttgtcctcaaaacttccatgtatgagatagagtcagtagtatacttatttctattttctaaccttcttcccacaaaatattttggacaacaaactaagagtaatttgctagcatctcagaagctaaacaggtgaccaatgatggcactgccaaaataccccatggtaattcctattcagctaagtcagttaaagcccatacagcaaaagccctctgaattggaaatactaatggaagggacagtattttaccaaactacaaaaaacagcaaggtgttctctcttctgcaagactgacttttcaatagctaaaagttacaccaaaataataataataataaataatagttaggtgcgtctacctatttgttttattcaatcacagaaatctctgccaccttatagaatcctgaaatttctgcatcttgcgactgacaaaaagagaaagggcaactattgggaggccagggcaggaggattgcttgagcctagaagttcgaggtcgcagtggactatgatggcaccactgtactccaggataggtgggcaggggtaggggggagcggggagagtgggggcgcggccaaagcctagagattatggccatagaaataaaatagatttgtgatcaaaccccattgctgctaattacgaggcatcagcttgttcatctgcaagtggggataatctgcttaaggtggttttgaagaccaaatgaggcaatgtacataaaatgtctggcacagtaccaggcacacagttgcttctccctaaaatccatgacacctactgaattagtcttttttaaatccatgaaatgaacattactttagcacttactctctttcatataccaaatggttaatagacagtaaccgttgttttaagtgtcgtacatgtattaatacatttaatctcacaaaactctatgaagttagcactaccgcgatttccattatacagatgacaatactgaggcacaaagaggctcagcaacttgcccagagtcacagagttagtggacagtagaccaggattcaaacccagacagtctggcaccacagcacatattcctaactacccataccatggtgcctttgaaatgctggagaaacatcactgaaaaagcccaaaaaggtagacagagtgatagacagttggacagctatgtgataaaacagcatggtaaaatgtcagtggcagaatctaagtagcgggcatacaggtgtttgctaaaaaattctttcaacgttgctgtatgtttaaaatttttcataagaaaacatcgggaggagagcaaggaagagcccagagtgtcatctcctcctcaaagatggaagcgtactgaaaaaaaaggttacgccaataatgtcaggatgaaaggatttccccaccccgacctgcctcccctccaaaaagtaacccagttaaaatctataggccacagattccagttacaggttgccccaactggggccaatggctgagaaacagagagaagcagatgggctgtaaaactgggtcctctgccagctaagctagagaaaccatctcccaattgaaagtgttaatggaaatgccaggccaaagcagtcgacaggaaacgtttcttgacgctgtacatgcaaacaaatatggcttctcctacaaagacaaagaatgcagtggtccaaccaggcctgtctttaagtactggcaagcacccaaggcaagttaacagatttcaacttctcaggctctatagatgagtaccagctcttgaagacctcccaggggatggaagggaaggaagagtgaggaaggggatttcatccaggtgaagctgagccagcgattaaaggggaggaggcgtgagtctgcagcggtaatgcccacacctgggggtcaaggaggaaactgaggcagtgctctcaaaggagacaggttatgtctttcacaaatgctcctatgactggtgctgtacggaatgtaatgagataaacccttgaactgaaagcctgacagcttctagactaggtctaagggaagcaagtaaatgagagacagaaatggaaagaaaaatatggtaagaaagggaattaaattttaggcatgttcttatacagttggcaaaagtgaaaaatgatgcatctttttgaaagagcaatttggcaatatcgaacaaaaacatgaaatgtgtccaccttttgaaccaggaaagtccactactgggattttattttacaaatgcaattatatgtgcataaagatcaaaatacaacgatatattactgattccagcattgtttgtaaaaacaaaagtctgaaaagaaccttaatgctcatcagcagaggacaggcttaatgaattacatacagaacactgattcaaaggtaaactccaagtcattgaaaagaatggaatccatcttggtgctgatggaaaaagagctctaaaatgtagctgtaaacgtgaagtggaaaaaaacaaggagcagaaactcatatacacatatcatttttaaaataaggtgtgtgtgtatatgcacacagattctctatataatatatatatattatatttttttaaaggcgagcaagagaaaggaggggaaacaagtatacttgtatacgtataaacaattctaggacaagaaactggagaagtcaggatattagagacttttcactctatacccttttttattatgattgaattttttaattctacacagttttctcactttaaattacatatatacgaatattctacataagaccatttaaaataaacttttattcataggaaatgtaatggtttgtttgaaatttagtcataacatccctgtaagtttcatgcaattaaatgcttatcgtatgctaaacatttgatgagacgaccttaaatccaaggtagtcagagagcatatttgtagaccaagttttacatgggatacaatcaaaagaaggactacgtaatttgctgtattaggaacatttagcaaaaggctaacactcagctcagagtaattcaagcgaaagagtaaagttattatcatactgaggtccttcatagaacccaagggaagaattgaggctggtctggagaacaagggaagtgaagacttgaacaccgtggggagtctctccatcttcatgacttcatttcctctcactgtacaatagtagcttcttccacatgccacaaaacattgctctcacagttcctagctgttatctgtaaccatttcaccgggagcggagttatttctcaagtttggaagtactggcattttggctggtatggttctgtgttaggggctggggggtggctgtcctgtgcattgtagaatgtttatcagcatccctggcctccattccccctcctcgtagttgcaataaccaaaaatatctccagatattgccaagtgctccctaggggataaaattgccactgacctgggagaaactgaactgcttgctcattcaccttcccaagtgctggggaaggacgctgactgcctagcttttggctcaaatgtggctgaataactagagcacgcttgcactcacaaggtgaccccttcataagcttgtggtttaaggagttgttgctctttaccactgctatagggctttccctaaaccctctaagtcagtactgtccaacacaactttctgcaagaagatatccatcatgtgctgtccaaaacagcagccactagccatatggggctattaagcacctgaaatacagctcctattatcgaagaactgcattttaaaattttttatttgactttcattaattaaatttaaatagacacatgtaaccctcgaccacctaacagcacagctctaagtactgagagcatttaagctcctttagaacagttgccagcataccatgggggcttaataagtacttgctgaataaaggaatgaataggattgggctcagggtcttggttggcaaaagtcattaaaccaactcagatggttccacccataggaaaaatgggaactcagtgagaaaggagcagaaacagaagcaacccactgtccatcaacagatgaatgaataaacaaatcgaggtgtgcatacatggcagaatatttattaagctctaaaaaagaacactattttgacacatgctacaacgtgaataaccttgaagacattttgctaagtgaactatgccgatcacaaaaggacaaatactctatgagtccacttatatgaggtaccaagaataattaaattcatagagctagaatacaatgttggttgccagggatcgggggtaccaggaagtggggacttaatatgtaatcgataaagagtttcagtttgggaagatgaaaaagttgtggagaggaatggtggtgacgactgcacaacaatataaacataactaatgccacagaagtgtacatgcaaaagtggctaaaagggtaaattttgtgtcaggtatactttacaattttgttaaaaaaaaaaaaaaagaatcaagaaagcttaatatggtatggtggactgaaccattgctcacaattctttacagcatccctatactccagaaataaatggaacaaacctgaacccaaccccacactctggagccaacaccagccaacccacaccctaagtaaagctaccctacaaagctatgactgagagaatgagatccttgctgttgcaggttatgggttccagggaagtttgttacacagcatgtttatagcaagagtcagatacattaagtctcaatggtcatggctttgccaccaagagaacattgaaagaataatgaatacttgccacagtgtggctaaggatcagctgcattctaaaactacagatagatcagttttaaaaaataaataaataggctgggcacggtggctcatgcctgtaatcccagcactttgggaggccgaggtgggcggatcacgggtacaagagattgagaccatcatggccaacatggtgaaaccccatctctactaaaaatacaaaaattagccaggcatggtggcgggcgcctgtagtcccagctactcgggaggctgaggcaggagaatcacttgaacccaggaggtagaggctgcagttagccaagattgtgccactgcactccagcctggaaacagagcgagactccgtctcaaaaatacataaataaaaccatgaactatgacatttgatgaatcattatttaaaaggtccactaagcctcagatccttgaagaaggtgggtccaatgtagaactgtgcttcattccttaagagtctatggattatggtcttaagtgatgttgagcctgaagaaaacaaaccctggcacctctcataacccattatgatctctggagaccatctgattctaaagagatgcaatttgaaatgctccctgaagcacttcaggcctcaacattctcgttaaatttcccctttcagctgtccctggcagtcactccaagctggcagccaacatcttctactgtctgcaaccctccaccctgaaaggaaataaaatctacatccaagtcaagcacatgttttcacgcaattcaaagaaaacaaactgtgaacaacctgagggctcacaggagccctgttatcatctacaaagactcgtgaagcagactcgggcacatcatcacttccacaagacacagaagccttcctgcaccctgctgggagaagccctcccagcttcctgcctgacacacttccctggactttaaccagctctacttctctccacctctgtaccagtgaccaaggaccagaaccagttaagatttttatttttcctaaggagcaaacttcttacgctgcttcaccccaagagctcaatggagtttcctcttgggcacacttaataatcatgtcgtacctcagcaagaaggagcagataataaaatccaaaggcaaataggacaagctgttagccagggatgagagaactagcaaagggcaacagactattctaggaaataagaaaggaggtgcttgggcaaggcttgctcaggcccaccttcctccagcctggcagcctgactggtccctaattctgccacctcacattgcaaagcagttcttatctctcatttgaaaaactgacagggacagaagacagcagacaagaagtccacacacactagcagcagaaaagaaggtgaaggagagaagaccgtggaaagaggtttataacataaagccattgttgctaattcaaattgttaactattgcgagaaaggagcagagaatatattttagaaaatgtccagcagaagaaattttgctggttaattgactacatcttggtagttttaaatattttctgatgcagtcaggttcctatgtctaagacatatgcctgtgacatatacatgtttcttcctttattaaaattataataaattaattaattaggtattccttttaactttgtttctattatgtaaacaacttctgggcagtaggcactatatgatctttactcggccagagccatttcacttccttttatttgcagtttctattcagtccaaaatatcatgtatttttgctaaaatcattatgatcccccctgaagggctaggactgggtgagatcagctgctaacaataagaataacgatgaagaacaacaaggggaaaaacatcaagagaagcagtcagatactcaactattcacggtccacatttattaggcacatatacgcatacacttaatcctcagaacaacacaaaaacatgtttgttttattcttattttatatatggaaaataagctcaaatgagttccagcaagttgatgaaagttaaacatatgaaagacagcggtgctcctatgaaagccagagccaatcaatcaagtcttgttctcccaaccacttcactagtatactacctcctggtggttaccaactacacttttactcagatgaaaagtaaggcagtccaggtgtggtggctcacacctgtagtcccagctacttgggaggctgagatgggatgatcacttgggcccaggagttggaggctgcagtgagctatgatcatgccactacactccagctgggtgacacagtgagaccctgtctcaaaaaataataaaataaaataaaatataaaataaaataaataaaaggcaatttgttctcctctcagcagaacaggtgccccctattctcactcatctcagccccctttcctaacagtcaccaaaatgttatgagataaagtaaatttttgttaagttctctaacctggtattttctactcttttttcttcatcttcagtacctttgtaagggaagtagaaaaaatttcctttgggttgtacacgatttaataagatacaccatttaaagttctgactattgcagctcccatgatactctgatacaaatttggccaaaccacgctttaagggctctgtgtacacacaggagatggtataagtgaatgtctcctagccaaactatgcactcccgaagcatggtactgcatgtcactacacagccatataaacatatgcacaacagagcagctaagagcttagttctgcatttgaaattcaccttcaattcttactgatttttggactttgttcctaattattctaaatcttagtttcattatccataaaatagggataatacttacaattccttgtgaggattaataaaagaaatgtacataaattgcttagcacagagtatggcatagagaaagcactctatcaatattattatttatttgacccaagtctcattttctttcttaaattccttagtacctttttgttttcagaacaattcatataatcagggaaaaaaatgtaaacagtgaagacaaataatccacttaaagcattacataatttataaatgctgatgccataaaatatgctttgcattaatttcatctaaaattcagttttatagtatacatcaaatatggtttaaatggatgttgattgttcctttttcagaattagcatgaagaatattaaaaaaggaaaggtacagaaaaataaaatctttcttatttacttctagaattcaaatttaatactatgaaagtaacaaagtagaattcaactcttgttttgctgaagacaactagatattttgctccttcaaagcatggattgtggcaatcatcttagcatcctaatcactatgcactgttcctgggaaatagtaggccctcaaacatttgttgaaagcataaagagtgagcaaatgggagagtgggagggaagaagggagagtgggagggaagaagggagggagggaggagtggatggatggatgggtgggcgggtgggcgggtggctgggtggatgggtggatgggtggatggatggatggatggatggatggatgcatggattaaccaaccttatgttgccagtttgtatcagttatttattgctgtgtaacaagtaaccccagtcttattggcttcaaacaataagcatttattatctgacagtttctgtgggtcaggaatccaagactggcctagctgggtggttctggctcaacatctctcacacctctgcagtgttagtggggctgcagtcatctacagcttgactggtccaaaggatactcttccaagctcattcgcatggctgtcagcagggggcttcagttcctcactgtgtgcgcctctccacagcactgctcacagcatagcttctcccagagcaagagatccaagagagagggaaatagaaaggatgactaggacagaaggcagatttttataaccttatcctggaagtgaaacgccatcattaggctattggtctcacagacctgggaacagactgcacgaaggtgtaaatacaagaaggcagggatcattggaggacatcatagaggctgtggagtttgaaataatcaaatcttctaaattgcaaagccagtaacaaattaacatagtaccataggcagggttatttttgtacagctgcaaaaacttattcaaatcattcatattatgttgcaaagattaaaagggaaatagctatttaaaaaaaaaaaaacagtaaatatccatgagaaatgtcaacttggattttcttcctaacccaaaaatgattgaaatgttcttcctgcccaactttcaactcatggcaatagttcgttttcattctaaaaattcaagacttgactcagcaaacacatcagtgccaagaaagcgaatttccaaaattatgtctgtctctttatggagcacaggccaaacttaaaggaaaaagaatttagaccacaaaataatctgtcatttctagtcttcataccagcatattgaaatgctggggtcttcgacattttatataaggcataaaatttaagaaaatactttctagaatgccttattacccaagtctgaattgaaagatggtttttaggccgggcacagtggctcaagcctgtaatcccagcactttggaaggtggaggtgggcggatcgttcgagcctaggagttcaagaccagcctgggcaacatggcaaaatcccctctctaccaaaaatacaaaaattagacagtctcataacccaatctcaaaataataaatagataaaaattaaaaataaaataaaataataaagaaagatgatttttgcatcaccaaatctttacactgatttctctctagtttttcctttgcaatgaaatgtcactcagacttggactaagattaagtcataactgacagctgttgactctctcaagctcttctctgaccgtatcaagcctgagtatccttattttgcacattcttccttatgtaagatgcttctgagggatggtggcagtggctggcatgtactaatacaaaatacttcaaattatatttttgagctggaaattcaagagaaacaaataccaggctgaagtcagttgctactgaatgatggagaatctccattccaaaggacagtctttatttatggcttcatcctaggttggtgccttcaaagttgtcctttgcaagtgtttcatcccagttctactctgagtgccaagaagccaggaacatttggtgaactcggctatgtctctctgcactggtggtgactttttgctgctcctccctagacaacccctatgtgacataagatgatattgtaaaagtcataagatattcacgaattaagcaaaccatcaccaataccttaaatgatgtaattacttatatatagccattttttaaacggagtgggatgagggatgctaagatgtaggccatacaaaatttatttaaaagatcttttttgggccaggcatggtggctcatgcctgtaatcccagcactgtggggagacggaggagggtggatcacttgaggacaagagttcaagaccagcctggccaacatggcaaaatcctgtctctactaaaaatacaaaaaattagccaggtgtggtggtgtgctcctgtaatcccagctactcaggaggctgcaacacgagaatcacttgaacctgggaggcagaggttgcagtgagccaagatggcaccactgcactccagcctgggtgacagactgggactctgtctcaaacaaacaaaaaaaagacctttctcactaatgagtttgtcgatggctaaaaaatattttgatcatgttctggagttaattaccctcacgtttgactttgaaccaaactcaattacatacaagaattaatcgaaacacacttagcttaaggcacaggtaaaccatgaagaagacttagaagctgtgcagtgtcatcgtaaattagcagaagctttattacctgccctaattcaaattacatgctttcacacttgctttgttcaaaaggtacaacaggtagaaggcatcctcaaatgacagcttcactctcagtggtgtctcttacaggtattttcaagcagaaattgtgcacatattacaagttaacaagaaatggaaaccatctcagcaggtaatctttcaaatcccaattccaggaaaccaaaatgtcaattaaagcaccctgggctttttagtgatgctcaatacctacttataaatgattgtgatgttataggttttctttccatctaacttgtgctttaggcatctcaacattggaaaggagaccataggtcatcatggagtctaatcctttggccccaccaccatcccgcagtggcatatgtgaaaggttgtcaacatcatcactttgttgtcactgtcaccctcaacctacgaggactccacttgacttcatcctgaaaacacacttaggtacaggtaagtatgctttcagtgtcccagaacagcgtattcgaaaccagatcacgccaccgctcagctggacctgccacccttataataaaatcaaaactcggccgggcgcggtggttcatgcctgtaatcccagcactttgggaggccaaggcaggtggatcacctgaggccacaagttcaccaccaacccggccaacatagtgaaacctcgtctctactaaaaatacaaaaatgagctgggcatggtggcacacacctgtagtcccagatactcaggaggctgaggcacaagaatcacttgaacccgggtggcagaggttgcagtgagccgagatcacaccactgcactccagcctggatgatagagtgagactccatcctcctgccactaccaaataaaaaaaaaaaagaaacctcatctccatgacctgaaaggccctacaggcctccatctcctgtttgtgcccgacttgagccacattcatctgctagttcttcctcaaacctgccacgttctttgccgcctcggtgaattgttggcactgctccctctgcccgctgtcctctgcccccagatcaccaggagaccaactcctactcaaaatccaggtcctgtctcaagtttctaacttccagagaggccttccctgaccagtgcatctaacacctattgcattacccattatctctcaaaactagctgttatttttttccgcatttattcactcacatgcctattacgtgccatatgtgtgcacacaagatggtaagctttataataatagcagctgatcaaagctaaagcttacactgtatggaaaatttactatgtgacaggctcagttctaagcacttcagtttctcacaagcctataaggcaagtaagaatattatcctcctcttacaaatgagaaaactaaagcacaaagaggttaagtaacttgtccaagacacacaaccactaaatggtaaagctgggatccaagtctggaagtttgtggctctagaatccacactgataagtaggaaattctgcctccttcccacaagagcagagacctgctctgtcttgctcactgctgaatctccaggagcctagaatgcttggaagagaaggccaggggagggagctgactgtctcctagcctaggtggacttcctttttctctcctatcataccccaaatacttccaacccagggatcctatcccccattcctaacagtatcctcagttccatcactgcaagtgtcatctgaaatcctacaatggggtgactcagctcaaaatttcttttttttttttttttttctttttgagatggagtttcactcttgttgcccaggctggagtgcaatggtgcaatctcagctcactgcaacctccgcctcccaggttcaagcaattttccagccttgcgtcctgagtagctgggattacaggcatgcgccaccacgcccagttaattttgtatttttagtacagacggggtctcatcatgttggccaggctggtctcaaactcctgacctcaagtgatctgccctcctcagcctaccaaagtgctgggattacaggtgtgagccaccacgcctggctcagctcttaatttcttcattcacaaagcaataatttcgaggactcagaaagcatctcttccttcattcactgagcccaactatccatctcactcacgtttttttaaaattctggaaaaagaagtcaagttagaaagaacagccaaagtttttttcttttcttccccccccccgccaccccccacagctactcacagagatatcaagatgtctggaacagaaaataaggactgaatattaaactcacccagttcaattttcttatagtaatttaccaaataaggcataacctcagcctacaagcccttccttctactccagcttctatttgggtcataatatatctatcttcaaatgatcacattcccggggtggaaaagtagcctgttgcttaatcaaaacgtcatccaacaaaaaccattctcgcagttaaattccgtttccttcaggagcagttggctgaaagctcgctgggacatgtggtttcagctattcttactcttcagggaagtgctatttttcttcaaagcaacgtagcccagcaaccccaaggaaacctgattaacttctttggtgatgtgctagtaaaactcactgttgtcttgcttcagggaattttaatggcagcatttctgtttcattcattagaaccttgaagtacccaaagaaatgaatatcctttctctttctttgttcctcattttgttttcagaatgcaggtcaggatcagaaactgggaaccatgtgacacctctgcaaagagtcgataggtagataaacttgatggcttgcaatccaaagggtgctcataaaggaaaagcttaggtgttaataggacatgccaattactccagtgtcgggctgcatagctcagatggctccagcaccaggccaagagaccaaaaattcagaatcagtcttctcaataaactgtgagctcagcaatattccaatattaagcagcaccctggactccagagagtcatcttgaaagtatgtgcgggtgattaaagaggaactggcctctagagtgggtcactacaaactgaccatcattcccggaaaagctgctgagcacatggccttcagcacatggccttgtccctgggcaaccgacacatctggatgagggtgggacaagtgaacagtggtgggattaattatacaagcaaacagtggtggctttaaggtccagcttttaaaaagctggggccaaaaagttaggtgttttaaattctgggtcatgccccttattagctgtgtgacactggacaaattacttagcctctctaagccatacttttggagatcatttgaaatatagcacataggtatatgaaaaataaacaggtaatggctgggtgtggtagctcacgcctataatcccagcattttggcaggccaaggtgaacagattacctgaggtcaggagttcaagaccagcctggccaacatggtgaaacaccgtctctactacaaatacaaaaattagccacacatggtggtgcacgcctataatcccagctactcgagaggctgaggcaggagaatcgcttgaacccaggaggtgaaggttgcagcgagccaagatcgccctactgtgtactccagcctgggcaagagactgagactccatctcaaaaaaaaaaaaaaaggcaagatagagaagtcattgtgacttagcacagagttgcttatcagtagctgaggtgcagactggttaaatgatgggtatatataagagaactagttagtacacaggtcccctaatgtttggtattgtggaagaggccctggcctgagagttggaatgctcgcttattagtgcaagcacagccacagattatatatgtgctgtagagcttaccccgtccaatgtttattctacttaaatctaaataattacaattaaatgaattaaaatgaaatagaattagaaatttaatttcccggccaggtgcagtggctcatgcctgtaatcccagcactttgggaggccaaagcaggcagatcacttgaggtcaggagttcgagaccagcctggccagcatagtaaaacccagtctctactaaaaatccaaaaaaattagctgggcatcaaggcgtgtgcctgtaatcccaggtacttgggaggcagaggcagaagaatcacttgaacccgggaggcggaggttgcagatcacgccactgcactccagcctgggtgacagagtgagactccatctcaaaaaaaaaaaaaaagaaaaggaaagaaaagaaatttaatttcctagtcacactagccacatttatttcaagagctccgtagccatgtgtggcttttagcttctatattggatagctccactgtagaacattttaaacatcactgcaagttctgttggacagtactgctttagcaagcaggtgaaccttttggctcccacttcggcttttttgaggagttggtaaaatatgaccattaagcataactttggagttatgctgacttcagattctgattctggtttctcaaatcctgcctgacattgaacaaacaacttgccttcagtttcatcatctgtaaaattgagataataatagcccctcacagacttataaaatattatatgagagactgtattagatatatgtggttagtacttcatatggtttggctgtgtcctcacccttctcatcttgaattgtagctcccataattcccacgtgttgtgggaggcacccggtgggagataactgaatcatgggggtggtttcccccatattgctctggtggtagtgaataagtctcacaagaactgatggttttataaggggaaaccccttttgctcggttcttattttttccttttgcctgctgccatgtaagacatgtcttttaccttccaccatgagtgtgccgcctccccagccatgtggaactgtgagtccattaaacctatttttctttataaattacctagtctcaggtatgtccttattggcagtgtgagaacagactaatacagtattaaatgctcaagagatagcatgtatgtattttacatagagtttatcatttgtatcaggtctcgtaagtcgaggcatctgtctgcctccagagaccaatctcttaaaacactttctccccttgcagggttggagactttcactatgtaacttaaaataaaacagtgaaggaagatttttcctgcagtgccattttgaccagagctggatttactctaacaagtgcctgcacctcttggtcgagttccctgagcatcggccctctcctgtggctttgggaagaggtcttgacttaggaagaaggcttccatgatcctctcagcctgagactggcctggggttttaattcccaccctctgcttatctcttggccgacatttgggcatgccacatgccccttctttggtgcaaggtctatcatctgcaaggtgcattttacagaaaaaaaggcagagtcctgctcttgacctttctccttctcaccagggaaatgcttcatgccatccaccctgagcagaagtccagagacacctgggcaacttccatggtgcatttaaaaagggaagaaatgccagaatacagctgtaaaaatgatggtatattttaaatatcaatacctaataaatcaatgcttttaatgcctacataatatgccacgtggagtgactgccattacgagacaattatggtctcataaaaaatattaattatcagtgtcttgtattgtagagtgtgtggtctggtaatagggctcatgtgtaacatcgtaatgattgtattgtcatttcagtcaccattatagtgactgtatatctaagctcagtaggcaccagtgccaaaaatctacatttgaagccctttgtgactgatgcatcccaggtactaaaagctctcatgagaggtcctgagagcacaagtcctggcttacttcaaaaaatatatatttttgtttgtttgtttcttaacagtaaggaaaatgattttttatttttttatttttctaaagacaggctctccctccgtcacctaggctacagtacagtggcacaatcatagctcactgcaacctccaactcctgggctcaagggatccttctgcagcagccttttgaacagctgggaccacaggctcatgctgccatgcccaggttatttttgtttttgttgaaatggggtcttgctttgttgcccaggctgggaaaatgaatattttaatgcaaggggtttctcagaatagaggaaaagttcaagacacatcataaagtaaaacttgtttgccttctgacataaatatttgcttttctttatatgtgcatataatttatttctctggtcttgccttctgcttcagtagttactgatttatgaaccaatgtttagtagtgctctcctttgaagctggggaaaattaagtgaagttcttttatgtgaataatgtggagtacaatgagactctccgaggcctctctgtgaaatgactttaaaaccactggtgagcatttcaactctggacttttctgtcttttaaaattcactcacatagtttggatgaaaagaatttcaacagacaatgagatttagatagcctgattctaagtttcggtgctcttctccaaatacagtttctttttaggtgaatattatgttttaaaattttttaaaaatgaaattagagtttgatagcagtcttttaaataagtcatttccccacccctccttatctctctctccctcccaattattctgtcacttattcactgatgccctggctaacacagtcactcagcactcctcctagagagaacattagttgacaatggccgcttccagggtgggtaactttgccaaattacttaacttctttatgtttcagttttttatatttgtaaaatgggaatagtgatggtactcaccccataaggtgattataatagtacagtttataagttggtgggaggtttgaatgagttaatgcatctaaagtacttgaagtcgtacctagcacccaggaagtactcatgttgtcatattttactcatcaaatagtaattgagtgccttcttaaaaggtagtgtaggccgggcacaatggctcatgcctgtaattcccaacactttgggaggctaaggcgggtggatcacctgaggtcaggagttcaagaccagcttggccaagatggtgaaaccccatctctactaaaaatacaaaaattagccaagcatggtggcaggaacctgtaatcccagctacttgggaggctgaggcaggaaaatcacttgaagccaggaggcagaggttgcagtgagccaagattgtgccattgcactccagcctgcgtgacagagtgagacaccatctaaaaactatataaatagtgtgttgggtactaggaatctggtggttagtagaaagatgcggttttgcattcatggatcctcaaacacaccatttatttattaaaaattctgttgatactgggatgtaagtgcttcatggaactgtgatgaccaatctgcatgttcatatttcccctctccttcttttaaaacacgtttaatataatattttcaaaataaaatgtgtgtgtgtgtgtgtgtgtgtgtgtgtgtgtgtgtgacagggtctcactctatcgcccaggctggagtacagtgttacgatcaccactcactgcagcttcagcctccccagcttaagtgatcctcccacttcagccttactctcgggagtagctgggaccacaggcatgcaccaccatgccttgctaatttttttttctttttttttttttttttagagataggagtctcactatgttgcccagggtggtcttgaacttctgggcccaagtgattctccagcctcaacgtcccaaagtgttaggatttacaggtgtgaaccaccatgcctggcacaaaataccatttcattctcagattaattttgtaccatggagacaaggggaagttttctcttttctttgtagatgaagcaacttgaggacagatatttggaggtcttgtctgaggttcatttaaaatggggcagaggccccaggccttctaactctccatccagttctctgtagtagcccttcctaccccagctttggtactgatgtcaaccccagtgtttcctcatttactgagcatgtgtgactttcaaaaggctctgttactctcttgatttctgtgaggagcgagatagccatgactttaccctgaccatgtgactggaaacatactgaatattattggatggagaagttcacagtgtttcacaaacacatgacaagttattgttaacattatatgaatgggaggtggcaggtcaagtaaggccagagaagcattcaagctgacaccttgttcatgaatttaatctcttatgagaacagctagaatgatcatagtggccagtttggtagcctgatcattttggtcatatgcagaaatgttctcaatggactttgagagttagaattagttggtatacaggctcctccttggaaatgtacacaccaagcaattgagaaaagctggaaatgcacctgtctcaagtctcattgaaaattcctttaggtatcatactccaaaagattacatggaattgaacatttttgaaataaggacaggactaatagactttcttaagtggaaatctctcgtctttttttcccctggtactttgaaaacttaaaataaacatcgtttccagtatttgatggtttatttactaactacctgtttggaggaaatgtcatattgtctcagaacaatggaagctctgctcacaagagagcaaggagagggggtggttttcagtagtcagttgggatagacccagtttggctcacattttttgcatctctgagttcagatgaaaaggatagtgagtggcactgcagaaaacccaagaaaactggaaatagaaaatggcaattttgaaactaaagcaattaaactagtgccccatttgaacatgctcagtgacttggcttagaactgttagtcaagaagaatgtattaaatgctgtatttgtaaagacgtcttccctagttgatagattctctgcccttcattggcttttggagaatcagctcaagggtaaaagggtataggatagaaggagcaaatgggccagatgtttgtggtcatttccttccatttccagccagacatagctgattgatcatggtgcctcttctcactaaacacaggcatgtttgcaacatcattctctattggaattggcacatgaaacttatataccatccttgataaatgacattgtttttttctgttgatgtagtcccaattttacccatattaacttttaaaaaaaaagattgtcttatcttagtagaaatatctaagctcagctgaagaaatagattctataaatacccttacaacctaaacgctaattttatccctagatgagttgagatgtgcacctgaatttgtctcttgcatctgaatcagggccaattgctaagctctattaacagaagtatgtaattaagataaagggcaggagcaggacagccagtcctaaaattagctcttgccttgatgttccccaggtgcaagtgcacacagccttggtcctttcattctggatgcacccgatttccttttcaagatgtgtgcaggccttaccaggatttccaaaagcttggttctggctcaggttgggaagctgagattgttttctcctgtgggttgttattcgtgtttgaaatgtcgtctggcaccttagaagctttttgcgtaaatattctttaagataggtgtcacattatttatgtttagcttgtgatagtccaacggtcttcttacaagctgtttctggactggtactttgagaataatgtaatttttatcagctgtccattctttacaatgaaggtaagtagtgcaattaaggaagggattttttttttttttttttgagacagagtctaactctgttgcccaggctggagtacagtggcatgatctcagttcactgtaacctccacttcccaggttcaagtgattttcctgcctcagtttccagagtagctgggactacaggtatacgccaccatgttcggctaaatttttacatttttagtagagacggggttttgccatgttggccagactggtctcgaactcctgacctcaagtgatccgcctcgatctcccaaagtgctgggattacaggcgtgagctaccgcgcctggcctaaagaagggattttaagcctacctgtcaagggataccagtatagctacacatttcactcatgtgactttgggagggaagagcttgaactctgctattcctaatgtgcatccttgggcaaggcatgcaccttgtcatgtgctctagtatcctagatgaaatggagatggcatcagtaccgacccctcagggttggtataaggattaaatcaaagacataacagacatttgtaagtcaacgaacacagtgcttggcatatgaagctaagatgtaggtaactgcacattagaggtgggaggccagggtaggaactagggtgaggcaggcgagccacttaccttgggtgcaaaatttaagaggcaccaaaaccctcaagaattaagaattaatgcaatactttcacttcttccttcctgcctgcctgcttttctttcctttcttttttaaggcagagtcttactctgtcacccaggctggagtgcaatggcatgatccccacacactgcaacctctgcctcctgggcccaagcaattcgggactacaggtgagtaccaccatgcccagctaattttgcattttttgtagggatggggtttccccacattgcccaggctagtctcaaactcttgggctcaagcaatctgcctgccttggcctcccaatgtattgagattacagtcatgagccactgctcccgactacagtacttttaaaaataaaaattagtgtggtaaagtccatcacgaattacatatcaaaactgtaaataaattcaaggactgcccctgcacttgcatgcccctgcctcctagtgttataaggacaaaataagaccatgaatctgaaaacgggttgaagatataagtgtaagttattatctgaacacattgttaaaagcttaaaaaatgaacaaaacaaaaaacctctcagcttttcagagcctatttggggctcaagacattccaatcaagtatgaaaacaaagtcagtaagtaccaggaaacattcagggacccctacaagttactcaaatctacacttgtcccgaaattcaggatatccatttgtgttggtgacatcctattttttttcattcaacacagaagccagagtggtcagctatttttgaggtgaaagttaaagcaggcataactgtgctgttgacaatgttggcgactggccccagtgaagggggttatgcagacaatacccctaagtacagtggcagattgggagggtggaggtctctcctcagtcacatcactccagatgagccatcagcggctgcaaggcaagatttctactaacaacgtagagatgtgccacttccaggaatctacctacaaatgagggcaaaaccagagttaacctaccatagcagaaacacaacaaagaacacaatgagatacagtgaaagggagtctaacctctagaaaccataatcagatcagcctgtagtttttccttgagttgtaattagcagctgttgttcagttcaagcactaagatgagcccagctgtctcattctgaggacaatcaacagtccaagagcaaaaacatggcacagcttctatcattataattagaaagaactcatttttaagaattatcacacctaatatgaaatattttgtcctcaaacttttcctattctattttttatcaccacccccacccactgacttattaacaatatttttatgccctgattccctgaagacagttaacagaccattttaaaaatatattttctcattcgacccttactcaattctgggagatatgcctggtaaggattagtctccccatctgacagctgacttaactaaggctcagaaagatgcagacaactgcctgtaatcctcaagttaataagtcgaaggacagagccaagaacctaggtttgctcagttttataccaacgctccatcacaaaattacacatttaaaatgcttcctatgcagacactattcaaagcactgtcactgcctttatataaccagtaagcctcaaacatggaagattttaagaggatttatatagaaataatgtaaaacatacattcaaacaggtagagagtgaagatgggaaggatatttgaccacattctcagctcagtgtttttaaattctggctgcacgctagacttgtccaatgaactttttagaagttctgtactccattcccataaattttgatttaatcagtgaagcatgaggcattggtatttttttatatcttcccacatgagtctaatataatgctactgtggagaaccactgctataggtcaaagattagtataaacagtacatgagccaggagtggtacgtgagatgaatttgtaataccagacataaatttatttttatttatttatctattttgagatggagtctagctttgccacccaggctggagggcagtggcatgatctcggctcactgcaaactccacctcctgggttcaagtgatcctcctgcctcagcctcccgagtagctgggattacaggcaccagccaccacacccggctaatttttgtatttttggtagagacagggttttgccacattggccaggctggtctcgaactcctggcctcaagtgacccgcccacctcagcttcccaaagtgctgggattaacaggcatgagccactgcacctgacccagacataattttttaatgttatacagttgttgtgttcattttactgaatatttggggaaagttagctgtcatataaaacctatgattttacagtttttacagactaaagtttaagaagtaatttgattgaaagaaaaatataaataaaactggttcaggtggtacacagatatgaagaaattaagaaagtagttcaagaatgactaaagtctagagatctgatgatgatgatgatgataatgaagaggattatcttgtgaggaaataaagaggaagtagcagacacaggaggaagagctggcaagacctgagtgagattaacgtgaggcaggggagggaaagaaagaggtaatacaagtcaccacggcaaggtgcgggatcatgaactcaagttcagtatcttgctccaagtactataaataccaggcaggttctcggtcagcattccaccactggcaaaaatggaaaagttaaagattagggaggttactgagggaagaccaacatctaaatcaaccgctcaggcttgttccctaacggaagatttacaagtctcttaggatgagtaccgcctaccaaagaatgaccctctggtaagggagactctccttgtttagccgaagcttctaacaccagatgagcatagctgtcaggccattctcaagcacatgcttcaagattcattcttcagatttcagttcctgctatggcatgatgttcctttgagccggtttgcctcttagcacagagtaactatgatgagcctgaacccagtataacgtaacattcctaaaggccaagtgttgtaaactggacctgctcagaaagagaatgctgactataaaaacttagtcatcttcaaatatataggccattgtgcagaagaacttaggtggtatatatacagatacagaaataaataatggtaaatcatattttgggaaaaattatttcctttctaattctctatcaaaccttctgattttgaatctcagatctcagctggatgtggtggtgcatgcctgtcgtcctagatacttgggaggctgaggcaaaagaatcacttgagcccaggagtttgagcctgcagtgacctatgatcatatcactgcactccagcctgggtgatggagtgagaccctgtctctaaaaaataaaagtaaatgaggctgggcacggtggctcacacctgtaatcccagcactttgggaggccaaggtgggcagatcacttgaggtcaggagttggagaccagcctggccaacagcgtgaaactccatttctactaaaaatgcaaaaatcagccaggcgtggtagcatgcgcctgtagtcccagctactcaggaagctgaggcaggagaattgtttgaacccagaaggtggcggttgcaatgagctgagatctgccactgcactccagtctgggcgacagagcgagagactctgtctaaaaaaaaaaaaaaaaggtaaaaaaaaaaaaaaaagaaagttaatgatactgtaatatatgaatatggcaaaactcatgaagctggtttccaagtgacttacatttgacacttctgcctccaataccatttctgagtgtccttcctcaatggtactatgaaagtgttcctctccagtgtcagtgtacttatgaaacctaggtgacagaaccagacgtcgctttttcttgttcccaggaaactgaggaaatagcttgggtgagctaatgcaagcagactacctcctggcctgtttctgatgcaatgaaattctaatacttaacaaacactacaacattttaagactttgctctgactgaccaaatatgagttttgatctagatatctttcttgcttagactcttccctaaatcacacggtggtatcagtttaaaaaataaatccaggccaggcacggtggctcgtgattgtaatcccagcactttgagaggccgaggtgggtggatcacctgaggtcaggagtttgagaccagcctggccaacatggtgaaaccccatctctactaaaaatacaaaagttagctgggcatgacagcaggcacctgtaatgccagctactcgggaggctgaggcaggagaattgcctgaacccaggaggcagaggttgcagtgagccgagatcgcaccactgcactccagcctgggtgacaagagcagaactccatctcaaaataaataaataaaaataaaaatacataaatccgaatgccatgagaaacaagcatgcaagatgatggcatggaagggtttgggtgccagagaaagtcggagtttggtcatgggtaagttaacctcacaaaaccataacatcctcaagaagttgtaggagaatcagatgaaaaaatgcacagaaggtacctcatacactaactggcatataataggcacttcataaatgtcagctctccctttcttgaataacccacacagttgcacatctaaggaaacagtgactcacctatatcttgacaaagacagtccttccatagattatttagtacaagtatttcctctactcctccagatccttgagtactagcctttattgtctgtggtgaaataacatggactgagtgcagtttgcattgaagaaaacctgagcaaaaaacagtgaactgtggtagctatgtcttgcctgccagaaagcagtacctttcccttgatttccaacactctgcttcccttcaataccaggactgtctaaccaaagctttccaaggacccttccaaggggatcttgttaaaatgcagattatcatctaatacatctgggagggcaaccaaaattctgtatttaacaagctctcgggagatgtgaaagctgctagttggcacatggaccatattttgagtaataaaaccctcaataccaccaacgccttccagatccaggaaagacaacaagggaacaaggggcagagactttatcagaaattcctttctctttccaagaatctgggcatcatttcggctttatttttattgttgttgttgttattgtagggtttcactctctcacctaggctggagtgaagtggcatgatcatggctcactgcagcctcaatctcctgggtcaaaagatcctcccgcctcagcctcctgagtagatgggactacaggcacacgccatcatgcctggctatgttttttttaattatttttagtagaggcagggtctcactatattgcccagggtggtctagaactcctgtgctcaagcgatcctcttgcctcagcctcccaaagtgctgggactacatgcacctggcttcattacagctttatttccagatgcttcatatgcaaatgaaatgtctaagagcatcccatttaactgagagccatcacagcaggccacatggagctgcttataaatgacagattactcattttcttttttttgctttacatggttttaccagcaacccatctgataccagtttccccactgaggcttaaaatgacacctctgcctcacttattccacagggtgtggacctatgttgacagaacaagaacccatgtagctagagatgggtgatttgcagcagaaacccacaggcaattagaagaaccagcaagcccttactgaacacctactgaacaagaataactcacagagaaacacacttcacacattagtctttcattcaacaaatagttatggggcactaattgggtgccaagcactgttcaagcctccatggactgaacccaaaaacttgttcaccattgtagcctttacacccttgatacgcttaattttcttttaatcaaattgaatgaaacttgatcacaagcctgtgagttaggcagttcaagtgtgatctcatcaaccactgtgtgacatcatcttacatcattttcagactctgtgaagtaagcattacctgtagctaataaatcactcacacacacacatagcttggggtcagtaagtcaacttctcccaggtaacacaattagctaaccctggaaatggaacaaaattctacctgattgcaaggttcatgcccataacctctagtctgtgctccctccccagagaagaaaggtaattccctgcctgccctcaagaagtttaccatctcctaaataagagaggacaacccacagccatgagacactaaaacaaatatggtaggccggatgcagtgactcaagcctgtaatcccagcactttgggaggcagggatgggcagatcactaaaggtctggagttcgagaccagcctggccaacatggtgaaaccccatctctactaaaaatacaaaaattagccaggcgtggtggtgggtgcctgtaatcctagctacttgggagactgaggcatgagaatcacttgaacctggaaagcagaggttgcaatgagccgagatcacaccactgcactccagcctgggcgacaaagcaagactccatctcaaaaaaaaaaaaaaaaacactggtaaatgactaaagcatgaaagtgagtggttccaagatgcaatgctctagaacacagcaaagagtgagagactcagtgcccttttcaaaatactttcaacttagaaatgcttattagtatctcccctcctcatatgctaagcaccccctgaggtagacaggcaacccagtcggtccaccctgggtgctgactaaagacttcttgaatgtatctgtttcaattatctactgttttatatcagactacccaaaacttagtggcttagaacaaccaaccaccatttcatctctcttacaactctgtgcatttagaatgtgaacagggaatgcagtatcttctgtctcagctccctgagctatctgttggggtgaaccatctggggtcccagctagaatggctcagacagctgggtgctggctcaaattgcttagctggaatcacagtatcatcacttctaccacactcttaaagtggtgcacaagccctgtgtaccttcaacaggaggggactctctaggcacatgaagtgggtttcactgaggctatctagccaacagctgactgtaacttacacacatcaatgaatgaacaaacttcaatcactggctccattcctctttcctctgtcctccacaaagaccagtcatttgcagagaggaaattaactcattgtttcccttaaccatgggaaagaaacaaagggttaagtggtcaggtgctaaacctgaggggcatggagttcttagacagaaagctcctccatccacatataagtttctcggggacaaaaacattgtctgttccccactgaccctcaactcttgcccatactgcaggctctagaaaactcggaaggaaccgtgatcctctgatgagtcactcagccttggcttctccctggtgaagacagacaacaagaaacacatttccataaaggtgctgagataagcaaaaacataaataacaaatgcaatatggtctagagatggacttgttacacaatggtgctgtccagaggagttcagcaatagccaataattacaatgagtcattagtaggtgagtggctcacaccgtcccaatgcaggagagccaagaaataataagacaggtcaattcaatcccactgaaagctcaagttaataagaaatttaaatatttttcaaagagtagaggtgatacagacaagaggacacatccttttcatccatttccccataaggatatacggctcccttaaagggttttttttttgagaaagagatcagatcctaaatgtatcacgaggccccaaatggtaaattcaaatcctattcaaactattgtcagggaaggagagaaaatgacagaccagcaagcacattcctgaagcagcaaatttaacaacctcccataatctcttccagctgagcatgcgctgctccaccgggcccttctattcccatttgtaattattcagtgcattcatttctatcctcctcaacagctatctaagtctgttctctgggaatcctgtgaatattttcagacaaaaaattgtgcggcaattaaaaagctagctgcgtgtggtagcatgcacctgtagtcctagctattcaggaggctgaggcaggaggatctcttgagcccaggagtttgaggttgtagggagctatgatcgtgccactgtactctaggctgggtgacagagaaagaccctttctcaaaaaacaaaacaaaacaaaaacgggatctttttcagctttctaaaaaataaccagagttctaagaatttgggtcccagaacctacaaattaaattggaatctacgacccaccattcattagttaggtaacactactgaacttcgcaactgggcaactattgaacttctctgagcctcagtttcctcatctagaatatgaaaataattacagcacctacctcctagaatgttaaggaggataaaaaaaatgataccatgtatttcaaggtcttcacctgcaacacagaacacaataagctctcaataattgccagctactattataacttgtctttttatactgcacctaaccctaaattaacagtgcaacacttcatttttttttaaatctcataattccaccccattcaatcctaactaaatttaaaatacacaccaaaaactaaaaaagagatacaggcacagctgccaaatggcaagtaaaaagccgtaattttccatcattggaatatatttagtgataactataaatgaaaaactaaggggggggggggggaagcgagcccccacttaaagttacccttccagtctgacagtctgaaaaccaaaaatgaagtcagacttccgctcgcttcactcctttccactcccgtctgtcaaagttgggtggagaactcccacatttcctgttctgagcccggagctctctgccaggtaaagcaatagacactccagcttgtgctgggacagctgggaccatcggagggccgggcactcacgaagtttcatatcattctttctaggttagttctgatgaaatcaacaccctgaactgaaggccccgggcggccaagataaaagattaagtcatcaaatgactagcatacttgcttcttaacaagcaactcttgtggttgtcatacacgaatgacgtcatctccaacacacaccttgtcaggtattctattcccaattttctcacagctgaaaaggaaccagactgctgattttctcaatttgcttagcagaggcagaaatttaattgggatatatatggttctttagattttcttctgcagattattttgcctccagcactttacattccccagggaatggtttttgttgtagggagtacttaaaaatgcatctatgtacccaccctacctcagtggaagtggtctggcagcacctcctcacataccctgaccaccagcagcactgtgcaagaccttatacaagatccaaaccactaaaacctccaccaacttatccacagaccaaaattcagatttgccaagatttataaaatgattgcaatgtcatgctacaaagaaaagaatatcggcctcacagaactcagtaaaaataatatcagccaggcgcggtggctcacgcctgtaatcccagcactttgggaggctgaggcaggtggatcacgaggtcaagagatcaagaccttcctggccaacatggtgaaaccccatctctactaaatatacaaaaaattagccaggcgtggtagcgggtgcctgtagtcccagctactcgggaggctgaggcaggagaatggcatgaacctgggaggcggaggttgcagtgagccgagatcgcgccactgcactccagcctgggcgacagagcaagactccgtctcaaaaagaaaatatcatatccatgatgaaatttcatggagttctgtaccaagtcaacctacccaccatctaaaattctcttgttcaactattgcttttgtgtttcctcttttccctctccacacacaccctctccccctcgacaccaggaacctaagacccatgagagcaaggactgttcgccaactctagtctcacaagacaaggcaaaatagtagttgttggctgggtgtggtggctcctgcctgtaatcccagcagtttgagaggccaaggtgggtgtatcacttgaggtcaggagttcaagaccagcctgaccaacagggggaaaccccagctactcaggaggatgaggctggagaaacgcttgaacccgggaggcagaggttgcagtgagccaagattgcgccattgcactccagcctgggcgacagagctagactctgtctcgggaaaaaaaaaaaaaaaacaaacagtagttgtggtggattccgttattttttttggcaaatattctctccctcctcctcccccagccttcatgggaagactatacttccctgacttgctctgggtatgtgctgaaatgacagtgtgtcatgtcagtcccaggaccaggctgcagaatgagacacatacagcacagtttcccagtcaacttgcagacccctgagtgtgagaatacttcatgctgaatgccacacagtttagggtagtttgttacatagctttttcgtgccaagaaatgagtgatacagcaagctctcaataaacatttgctgaagtaacaaatgaaaagactcaacttgttagcacttgcaaaaacccattaattgtgacaattctgcaacaaatcaagtattaagcctagtttttactctagaatatactcctttaataaaaattacatatttagaggttaagatttaagagaccaagactaatctgttaggccttccttatttgactagagccaaaagataatgatcacttatcccatttgtagattatactctgaaaccatttgatggtttttttggggggtttttctttttttttaccctttcctttcctaaaatgctggtgaaagcttcaagcccataagataccaatttttacagggtactattcctttcatctaatgcaaaaagccttgaagctcataaaaatgaggctatgaacttttaaggcacatagcttgtagggttagtgttgatgtatttccattacttgaaacatttaatggaagtagtttaacagttcacttacatattgtgtttacagttatttcatttcttaacagagaatagaatcacatctaaatggggataaaatcgcattacattctagaagtaccttttcattctgaccctttatcactcaaggtaagggctataaaagaatcccttttttaaaaaaaaaatttatttgaagttccggggtacatgtgcaggatgtgcaggtttgttaggtaggtaaacatgtgccatggtggtttgctgcacctatcagccatcccttaggtattaagcccagcatgcattagctatttttcctgatgctctcctccgcacaaccccgcactccctgacaggcaccagtgtgtgttgaaaagaagccctttttcaatgaaattataatttagggggataaggagaggaaagacaggcagaaatgagaaagaatcaataaaatctgggagcaatatgcttcctcatctatggtactgatatgcttactttcaatgtgccaagcatatgcaatatcaaaatttcacatgtataaatgattatgacctaccgatatctttctttacccctcaagtgtgaggggaaaaaaatgggaaaagcacctaacagagtcttcaggccttatggcaaatatatggtgaaatattccatgaataaaacaagtctattttaacatatactttcagaccaccttgggaagttaatcgttttctccatctcaaatcactttctacacatggtattaatgttggtttattcctttctttattatctgattgctaagttcccttttaagccacaataggacacaccaatgctccacaatcgttttgccattaagaactagttgcatcatgttttgcaaatacagcccagttcgagaagtctgtgttccccaattgtgctttcgaactaataagtaacctatctgcccccgagagagccactgtaaccacacagagttaaccttactctacctaaaagtaaagaaacttgacattttagttaaactaggtaaccatatcttgagaaaatgtactctggttaatcaggtcttgttccccccacgcttttttttttttttttttgatacggagtctcgctctgtcccccaggctggagtgcagtggcgcgaactaggctcattgcaagctccacctcccgggtccacgccattctcctgcctcagcctcccgagcagctgggactacaggcgcccgctaccatgcccggctaattttctttttgtatttttagtagagacagggtttcaccgtgttagccagaacggtctcgatctcctgacctcgtgatctgcccgcctcggcctcccaaagtgcccagattacaggctcaagccaccgcgcccagcccttgttcccttttaatgataaaacagcttgacattccttccccagatgccttttaaggcctccaattgggctcaagaaaccaggctgggaggtgatgttctgttttaatctctatttctccatctctttcttcctaccccaattaaattttcttattgaaataaacgcagggtttaaaaaaaaaaatttttaaacctaatacgactaaggcaaaaataatcccaacacatatactgtgatgcttctaccttgattacttaccaagggtaaataatggcacaagatgggccttgtgggaaataaaagctaaaactgtccaaaggcaccagacatgatgaaaggtattccacactggagtatttcaaccaggaagcaggtgagccagagagctctgctcagcccccatggtggggcaggactcagcacaaggggcttggcccaacatgggcagttaatgggtgtttacttcctgtccatggcagggcaacatcctgcatcacaggctaaacctttcatatcaggcttttacagaagggcagcaattattatcctctcagcccaccaattttaatgaaaacccatggcaggccaggccctgtctaaagtgcttcacagccattatttcatttagtcatcccaatgacccagtgaacaattaggaaattgaagctccaaaagttgcagtcggcatgtattaagatattataaagatgtcttgtcctggtgctggagatacatagcaaaatggaaaagatgaaattattctcttcaagggacctgctatcaaataggggagacagaaaggtctttagaaaataatagaatgtagttagaagaaacaaattcagggtgcccagagaaggcccctaagtatttgggggtggaggatctcaaggccatggtatttgagctcagtcttgaagaacaagtaggaattggttcgattaggatggaataggtgaagggggatgaagacctcccaggagtaaagaactcacctcagtgaggttttcaaaaagaaaattttaaaataaactttgaatattcaaaaaagatatataatatctaaaaattattatgattatgctagatccaaaccactaaaacctccaccaacttatccacagaccaaagttcagatatgccaagatttataaaacgactgcaatgtcatgctagaaagaaaagagtatcagcctcacaggactcaataaaaatctaaaatgtaaacacttgacagacaagatccctctgaatcctcacaactggaggaggcaggtccgataattatccctgttttatacagggggaaactgaggctcagacaggttacataacatggcttaaaatcacatgacaaataagcagaccccaaccctatataatgcagaaacttacatgtccgtggccttaacagctgctcctacctgcccttccaattttgcttcctgtccagttcataacaatgtgtctacctaacaaaaaacaagtagtctgaagaacaatggaaaattttggacatctgtgccaattttaattaaataattgcttgtccacaggccaagctgttaaagcctttagaaaaacacggaagctgaaagctctcacatatattaaacaaaagtgatcctatatgatcactagcaaggtccaaaccttccccttgcctcagtacttgttcccaaagcaagctcaggtttgatcaaccacttcccgcctcaagtcttataagccccagtgtgctcagaccttctgaagccacttgacaggcttcctgcctcaatttcatagattgagtctcataaacaaaaacaaatgccaagcacaaaaatctcttggcaataaaggggcctgcattagttctcctcaggtaaggattaacttcaatatttagcttagaaataaggcattttaaattcgcattttcagaaacactgggcaaatttgcagaaaagaaaaaaacacgtctggatggggaggggagatctcactgcattaaatgtttctataataaataattccctgaggtaccaattttaatcacttgacattttgtttccttttaatgcaaacatacagaacacaatactaccatttccaattttatttgtaaggatctagctcttaggtaggaattagggacatttcatggggtggggggtggtggtgaagatctctgtcttttctgaaatgacttgatgctgcttaaaactcacctgtcccacatagactatttttcttttctttttttgttttttggggacagactctcactctcttcccaggctggagtacagtggcgcgatctcgactcactgcagcctccacctccctggtagagggattctcctgcctgagcctcccgagtagctgggatcacaggcacccgccaccacacgcagctaattttttgtatttttggtagagacagggtttctccatgttggtcaggctggtctcgcactcctgacctcaggtgatctgcccacctcagcctcccaaagtgctgggattacaggcatgagccactgcacctggcctatttttcaaaaatagtgcttctgattcactgcacttcaaaggtggccttcctggtattttcaggtacaacaagcatagtaagggccatttgtccagacaggtaaattgcacctaatgattgacactaacaggagaattattaatagtacagagctggaattaacaacaaccactacatacacacacatatacacagtcccagggagtattagatctatagtcatgtatttaggcaaaacttccctttgaactgctttgatccatctgccctgaacatatgaaagaagaagagataactttgatacctgtaagactgtgaagatgaacagggcagttggtgcaaaactacaaagccctttccccttgaacagcagagtcacaggggcagccataaaccctaatacaaactcttccctccttccctctccttcttaccagccattcgccaccacctccccatgtggagacaaggacacaccacagcaactgcaattcagccacagagtaatggagagtggagatttggcttgttgattcaaggttaaagaggagaggcaggacatgcacggtggctcatgcctgtaatcccaacactttgggaggccaaggtgggtggatcacaaggttaggagttcgagaccagcctggcccaacatggtgaaacctcgtctcactctgttgcccagactggaatgcaatggtgtgatcttggctcactgcaacctccacctcccaggttgaagagattctcctgcctcagcctcctgagtagctgggattacagacacacaccacaacacccagttaatttttgtatttttagtattctgtatttcagagatggggtttcacatgttagccaggctgctcttgacctcctgacctcaagtgatccactcacctcggcctcctaaagtggtgggattacaggcgtgagccaccgcacctggccagcttcaactgtttttaagggtaacttggtaactgtgtagagcaaattctcacttttttgtttgtttggtttttggttagtcaagtaaagtagtgagagtagagaaagaacaaagaaatctgtaaccagttgtgaccaaccagttgtaaacaccactgcactcagacaagctgtttatttgtttataataatagtaacaagagaaggcgggggacatcacaataatctactcccaccccctttgtaaactaaaatgctacttcctttatacctgtgagactatctaaaacaattcagaagctgacgctcctgttcgccaaaacagatgtggggaaaaaaatcctgctcggattttattagaagccaaggactttcctcattctctctctctggttactaatgctccaaaataagccacctcaactttgtggcataaaacaaccctttcattatgctcacggttctgtggttcaggaagtcagacagaaatggggacagtttgactccacagtgtctggggcttcagttgggggtgacttgatggctaaaggctggaatatccggaggcatcttcactcgcatgtctagaggttgacactggctgtcggccgaaacacctacacgtggcctctctgcgtggtctctctgtgtgggcttagtctgggcttcctcatagcatggtggctgggatccaggaacaagcatcccaagatagcaaggcagaagcacatggcatttttacggtcctgcctcaagagtcacatggtgtgactttctgtcatactctgttggtccagataatcacaaaggtctgtccaggtttaaaaggatggtatatagacatcaccttccccactcccatggaagcacagtcaagttcacattgtatctggcatgggagctattttttgccaccaactttgggaaaaaaatgcaatctgccattgcagacaaaccactgatagatgaaatcccatgaacaaggtaagtccaaaaattctgagtctcaggcatcttcgactatcgcagatttaaagcaaactctgacaggcaaaagatcacaggagagagctagaagaatggggttttagccacagaagcccaccaaggtgcctttgaagccatgattacaaacactactcctggcaacaattagaagggtcctcaacatatattattgtatatacctttgctgttttattgcagcttggttccttctgtatcccattgacatctgatttaatgtacaagagtattaaaacatctgctgaattataattccaaagttcagatgacatcaagataaaatctatgaaactatgaatttgccatgttaaatggcttttttatttttaatggatcacagagggcagctgttttaaagcagtcccatatgcaaagctgtgggttaggtttaactaagaatcaatgtgacctacagatctttgaatgtgttgcaagggagaccacagtcttcaataatgctgcatctcccagcaggctgcttttgggccaagcaggagatggggaggcagagaagatcatctgcaatgagtggcccatatcttgattttcttttgtctcaacctaaaaatgatactacaggctcttcctatgttttaaggacaaaataggcccacctttcagacttctggttacatcactaagcaggaacaccattcccatcaggataatatcctcatcttataagtaacagcctcatcctcagctgttcaaaatcaatattcacagcctctttgcctctcctcacccactaagaaaatctttagcacttcccactcagcactaaccccattcctaaatctcccacgccttccccttgtgtcttactatacatattgaggccatcagtgtgtgtgagtggaaggggggaaatcaaagggagagaagaaaatagctgaaggacaaagacaaggaaagaagatgacacaaaaaggaatggcagcaccatgccagggagagatttggtagaggacaagaaacataccacaaagagatcttccatgcatctcccatggatctaccaggaatctagagatggaatgatgacaaataaacagagagggaaagggcacttaggaagggctgcaaaagggaatcacctgacttccaataagattgcaatcacttctagggttggttcctggactggatttctttgaatgacacactgggcctcgagtcagtcacttcaaaactctggatttacttgggttatgttgagctgataaaaaattatatttagagagatcagtaatttgttaagtgacaactcaattcttcccatcactgaaatttgtgactttaccactaccagacacagccaagtaaacagaaatctatcacattcatttagcccttattgtctattgctcatgaggatttagctgtccaccagacaggaaccagcaaccagtatggaagcacttgtgtggctggctgctatatgaataatgtcagcaaatgtgaattaactcatgagaggctgaaaaactattactgccagtattggatacgacaaaaaatgaaatcccaccttctaaagacagaaagttgcccagcattttatttcaaatgttaaagtcttaaaagcttctcctaaagtcaaacaagtaacttttcacttgtgacacatatatacacacatataggtatacatgtatatgtgtttatgtgtaggtatatatgtatatatgtgtgtatgggtatgtatatgtgtctatacatatacatatgagtaagacaaactagaatggtttattttcagcatatgtcaaaccctaggcaatgctgaagtaaagctttttcatctgtttagactctgatcatcctatggtaccagaactttaaggaggtttctaatgatgtcacatataatactgtcgtttaaagaaagtatgacataaaaacatatcaacacacagacacataaataaaacaggggaatgggattatgagttttaaatttttgtttcagttttttcttggtttagcggtcctctctttgaagaacatggttttgttttgttttgttttgttttgttttgttttgtttattagagatgcagtatcactctctcacccagtctggaatgtagtagctcaatcatagctcactgcaacctcaaattcctaggctcaagtgatcttcccacctcagcctcccaagtagctagaactacaggtgcatgtcaccatgcccagctatttatttatttatttatttatttatgtagaaacagagtcccacttcgttgcctaggctggtctcaaactcctggcttcaagcaattctcccacctcgacctcccaaagtgctgagattacaggtgtgagccaccacacctggcctgaagatcacatatgtcacgtaaagtctattaagcttgactacactcagggtacagtgcagatgctgggtcccatggcgctcaagagggaaggagtccctggacctgcctcggtagaactttatcagttctatctcattgtctcctttaagccccacggcgatcctatcttcccaatgacacactgtctcttttcctatatcattaacaggtaagaatcaagttgtaaacagaagaattaggaagccaaaaagcaggaaagctgagcaacacactcaaaatctaatcgctgcctgagaaatcaggaattgactctaaacacttggacacagcatgtcaccaacacagtccaactctagtgaggaggaggagagcgaggaagaggaaactcaagagcataaatgtgcaggataagggaaatggtgcaaggctgaagagaaattccttaactgcatcctaagcagctgttgtcagtaggtctgttgctgatgcttccgaggaaacatttcaggaccatttatcaagggaactggtagcagtaatatggatgggcttgactcaaacaagaaaatatactgcagacaacaaggaacatagctcataagtgagatgagccctagtacagcaataaccatttcagtgtatttgctatactttccttagggcagaagagaaggaaagatactaaattggaggagggaagaatgtgtgccccacacactagtcctctggagcttatctggctccatagattttttttttttttttttttttggacatagagtctcactctgtcaccctggttggaatacagtggcctgatctcggctcactgcaacctccgcctcccaggttcaagcgattctcttgcttcagcctcccaagtagctgggactacaggcatgtgccaccatgcccagctaatttgtgtatttttagtacagatggggttccaccatgttggccacgctagtcttgaaatcctgactccaggtgatcagcctgcctcagcctcccaaagtgctgggatcataggtgtgagccaccatgcccagcctggctccatagattcttactatttagtatagttcataggaccagcatcagcatcacgtgggagtttgttagagatgcccaacctgggcctactgaatcaggacctgcatccccagataattcacaagcacagtcaacgtgtgaatttacaatgctgggccctacaccatctggtgaaccgagagatttcaatcttttcctcatctcctcctccatttagtctctaaaacatgagcacccaccacatgtaggcactatacctggcaggcacagcaatgcccttgaccctcacgcagctcagagctgggcattctggggaacagacacaacccatacaaccacaaacgcacataaagatacaactgagtggcaagtgctgcaaaagggaaacaagtggtcttatgagagcattaaacaagatgagattctgtcaggccaggatccctggagaaaatgatgttagaattgaaatctgcaggatgactacatattaagtaggaagagtatgggggggcagggaacagtgtccagccaaagaggaaaggcttgtgcaaagaccccatggcataccacattacaggaacgacaagagaacaccacatgtacaatgaagctggccggggggcaggggccagaccatgagggctcttgtagctctaaatactttgatcctaagaacagagagaagccctgagaggctttaagcagggtatgccaggttagagaaaagaaggtataggcagatcccaggaattttactgaggaagcaggtctcagaccccagctatccccatttgtataaaagtttatcttcccttcccttctaacccagggccgtatcaggcgtaagccggcctgcctgccaccaaccccacaagacaaactgagcccctttcctaccaaagaaataagcaagaagtgccccagtgctaaagcaaaagaaaaacacacacaaagatgaatatgcctggtggctgccccaggacattggagggagtgatgcatagtacttcagattcttaaaaataaagaatatccggccaggtgcggtggctcacgcctataatcccagcactttgggaggcaggcggatcacctgaggtcaagagctcgagataagcctggccaatacagagaaaccccgtctccactaaaaatacaaaaattagccgggcgtggtggccggtgcttgtaatcccagctacccgggaggctgaggcaggagaatcacttgaaccccagagaccgaggttgcagtgagccaagaccatgccactgcactccagcctgggcgacaagagtaaaactctgcctcaaaataaaaaaagtaaggaatatctgaattcaagacctggttctacccctgactacctacacaaggtaaactttccaaggttcctaagaatgcctaacgatacctacataataatgttactgagagaattaaacagtagtgtctacaaagctctaagcatgaaacttaacacatagtaggtgttcaataaaaaatgtatatctttacacagcactgtggttctcaacctgccctcatgagcacattaactcttcaacctaaaagaatcattgttggctgggtgcagtggctcacatccataatcccagcactttgggaggccgagataggtgaggcaggtggattgcttgaggtcaggagttccagaccagcctggttaacatggtgaaaccctgtctctactaaaaatacaaaaatgagatgggtatgctggtgggtgcctgtaatcccagttactcagcaggctgaggtaggagaatcgcttgaacccgggaggtggaagttgcagagagctgagattgtcccagtgtactccagcctgggtgacaaagtgatactctctgtctcaaaaaaaaaaaaaaaaaaaaaaaaaaagaatcattgtttatttttaaaaacaataacgactaacatatagaaaatgcttagccacaacattaagcaatgctaagcatcacatgtattagtaagtcatcacaataacactatgaaatgggtgctgctattaactccattttacaacaaaaagtatacagaaagtaaggagcctgctcaggtactgagtgtgagtctctgttctgtggtgccttggccactcctcagggctcccaatatgcatatccctaggcaataacttgggcaattcacaaagtgctttcccccttattctaggtctccttgaactacggaactcttagcatgatattcactgatgcccaacaagcctgcttcactcaagtaaaaggctgaatgaaagaaactgcctcttgaaagaatctgatcctctgaccagggtgcaggccggcagatgataagaggctgaaaacaagcacacttctaggcgttcctcacttacaccattataatgaaacgaagctttctctggctatatggggctctgatgtcattagtaggacagctctttgaaaatcccaaacacccaaattttgataaaatctaactttcttttcagaatttccagtttgtggtatttggagaagtcccataacccctacatgaactgaactgtgtttatttccaaattttctgcacaccactcactaccaacttggtgtttacaaagcacctttgccctcaggatttccaggcagtgataaaagcatagagcaaatattttatggccggtctcatcctagtgccgtagtgggtacacagaatgccagccagctgtaagcaaaggggcaggacttgaaagctttctcagaggaagccaagtgttacctgtggtatttaaatggaaagaggcctgttgagtcaagtgccttcccagggaactggagggacaccaatttgcccaaagtcatccctggctggggaatataatagagggctagagttcagacttttcttccagctgatgattcatttaggacaaaagaatttacctttcctttcaactctctgtgacaaaaggttggagataccagaggaagccaattcagctaacttcaagggtgtccccacatggcagcacacataaatgcgccaaagggaaaatgaaagggaacggcccaagtattcttttctcgacaacaaacgttgcaacagtcctagagcgacgaaaagataggtttgaaagctagtcaaacatgagctcaaatccaagcacacccacttcccagatgtgtgttcttggtcatgttactgaagaaggtggtgcttattaagccaattacacacacacaaacatacacccctatgtcatatgcccacatgcagtgaacactatgctgtactatgccacccgcctccaggatccccctccaagacttgtgttggctgcagagagtcaccttccctgaggtcacatagccttcccagaacagccgcctccaatccttgttgacttgagggtatacaagccttgccctatcatcccaacccaggacaatactgaagaaccatctcaatgtcagagcttcctgcaggtcggctgggccttggttgagacgacttcacagcctaacttctcctccagcccaattccttcaacaggaattgattccaaaagcattccctaaccaatgtcctatatggtaatcatctctgagtttgctttccaggaagccagacaatatgctgaaccaaaaaaaaaaaaaaaaactggaatgagagatagtgaagtatggccaggtaatagtattaagttatttggattgtccttttttcaaggtcaagtaaaatgcaattctagcgaaaaaaatgagttaacttttttaaagggcaataggatacccaacagatgtccaatacttcctttttccttagctgtaactccccctacatcacacaaccttgtctatatcgatttgcttttgcttgttttagttaggatgggcaacaaaatggtatttcaaagttacatccttcaaattcaaaagaatgacagccactgaaacattctatgctcagttaacccaaaacaccaaacttccagatgcatacaggctttaatctgtcaaacttttaagtaaacttttcttggacaagttatcaagtaacatcttagaaattatttttttagcagagggcaaataaaaaggaattacaccatgatccactcaacatgaataatacaaactatactttatgcagtaaacattcattccaagtttttcctataaatataaatatgagaagaggtagtattaaaagttccatatcaccagtcttaccttgaaacaaaaaaaaaatattaagactcagtaataactagctaatttcagaaaagcagaggtagaaatggatgagagataaaaacagacaaccatttgggagcctgaggcgagtggatcacttgagaccaggagtttgagaccagcctggccaacatggcgaaaccccatctctactaaaaatacaaaaattagctgggtatggtggtacacatctgtaatcccagctacttgggaggctgaggcaggagaacaacttgaacctgggaagcagaggctgcagtaagccaagatcgtgctactgcactccagcctgggcaatagggtgagactccatctcaaaaaaaaaaaaaaaagaataaataaggggacagatgtgaaatcatctagcacagtgcctggcacatcagaagtgcccctgtaatgtccggtaaatctgaatcactgctattttttaactgcagctctttcccacccatccccatttcctctagggttttactgggaagcaaagaaaagaggaacctagccaactctgaagcccactctaggtcaatagtttgcatgtagctcatttaatcattttaactcctattgtgtctaaatttatgtttgaggaacccaggggtggggagggtcacagttttaaattttttaaaaaggtgtgctgttttcccaaagaagaacttcaattctggctgggcacagcggctcacgcctgcaatcccagcactttgggaggccgaggcgggtggattacctgaggtcaggagtttgagaccagcctgaccaacatggagaaaccccatctctactaaaaatacaaaattagccaggcatggtggcacatgcctgtaatcccagctacttaggaggctgaggcaggagaatcacttgtacccaggtggcagaggttgcagtgagcaaagattgcaccactgtactccagcctgggcaatacagtgaaactctgtctcaaataaaaaaaaaaaaagaaaaaaaaaaaagaacttcaatccaactaccttggaaccaaattaaagaaaaagatagaggccagactcggtggctcaagcctgtaatcccagcactttgggaggccaaggtgggcggatcacgagatcaggagaccgagaccatcctggctaacacagtgaaactccgtctctactaaaaatacaaaaaattagctggtcgtggtggcgggcacctgtagtcccagctactcgggagactgaagcaggagaatggcttgaacccaggacgtgaggcttgcagtgagctgagatcgcaccactgcactccagccagggcaacagagtgagactctgtctcaaaaaaaaaaaaaaaagaaagaaagaaatgcaaacatccccactaggtatttgaaaaagcatgttagggccaatgctacccacttttctcagacaatgaaaacatcgtcaatgatttgactgaagacttatttaagtaaaacggagatactcatacacctgacgaaaagaaaaaaggtaacttctcccctgataaagaccatgcaatggtggctccgcagtgaaccactacataatgtatcagggccatcttcctcaatttccctcataaaaataatacctgcttgctgtaaactacaccaacgagtcacctatgtcacagcccatttcccatttctcttgccccaattccaatcctcagaggaaggtagggtaaacacataattcaccatccaaagcagttcaccaaacactgaaagagggtactattaataattataccagaacaacaggtgtaaaccagatatttcccaaacaaaccgagacatatggtcacccttctcagaggtagccacagggaacatatccttgttgttccagatctttttttatttttaaggcacacacaagcatacccaaccaggtcagcagtagctgtgatataacaatgggatcatcctatagatgctgtctcttacttttttatttaatatatcatcatctgtttacatgtcaggacagagatccacctcacttttttaactgactacagaataagccactgtagggagataccatataatttttcaaccacccacaacacatataagccaacttgaaatttttgtctttacaagcaatgctatatagagaacacagccccacatatatcttttatgagtttgagtatttccaaagaataggtttctagtggtagaaaggctaggtcaaaatgttaccatttttaataggttcttctcaatactctccaaagaggccttatcaaatcatttcaagaccaagagttaataaacacttgtgaaattctgccaggctggtaaaggacacatgctatctcattccgtcattttcttaaatgttaacttaagacactctgggtccatggtacacttggaattttcctgcctccaggcctttgctcccactgttgcctccacttagaataacattccaccccatctctataaatatcctacagacaaatactaccttccccttaaggccagttctaaccctaactgacaacaaatcatcgctacatgatcttttccttctgggaatgcctgcagcactgtttaatcctgccccaccaccatcccctcacccagcaccctctcccagaccagacagggtggctcatgcctgtaatcccagcaccttgggaggctgaggcaggaggattgcttgagcccaggagttcaagaccagcctaggcaatacagtgagaccctgtctctacaaaaaaaaaaaaaaaaaatctaaaaaataaaaatagaaatacaaagacataatacacacgtactaattgataaattaagacagctatggtaaataaaaataagctttggatatataaaagacctggatataaagccctggctctgctgagcccagtaaagcaccttacgtcctgcaggcatccatttcctcattgataactgtggacgcagccaaccccctcccagcctgaacctaagaacctggtttgtttcccaactttgcctaccattaacagcagtgaaaaaaaaaaatcttaactcctctgtgcctcaatttcctactctcaaaaatgggaatgattataacacatttcatagagctgattgagaagtaaatgagttgataaaaagcacttccagcaaaggatggcatagagtaaggggtacatatatgctagatattctatagctactgccttaaaataacaattagatgatattttttaaatatgccaaaaagtttataagcaataaatgtctagtagcttaatttttatcccatctacactggaataatcaacagaaagaaaaattgaccaaaccaggaaactaccctgacataaagtttattggaaaatgtctatacgcattttctctctttctatctgtacatcaatcattctagaacactaaagactcagggatcacttaattgctctatcatcatttgtagcttcctacagagtggtgactaaattgagacttcaagaaatcgaaaggaaataacatgaggacataaagacagtatacttagaatgtgtttctatcaaatatgctccatataatttggtccaacaaattcagctctataaaatctcaaaggaggtagtggtgccaggaaagaagataaaaacccagagtgttaaaacagaagtgttttgagtcaattacgaagtctattcagcgcctccacaagcctagaatcaagtgatcagattcaaaggaggaaaactgacaaaattaatatggtaataactatcagtcattcagtgttgcctttgctctgtgttccatgccgagagttgactgcatcatttcattgaatccctgtagcaatcatataagatatgtgctcttattactgctacttcacagaagtaaaaacatgtacccaaggccacatagcaaggaagcagcaggaccagatttgaacccggactacatgaaattcaaatcctgtgcacataattactgagcatacagcctccaagccagaaaggtggaagggtcgactgggtcaaagctgatggcgggaccgaagaacagctgaccaatacacacaccctttgcaaagaagcgacgaggacacgttgctggcaaggctctactctggcaatatgtgccccagcaccggagctggagactttgggtaagtggtgctccggagagacccagggaaagtcaggcaaaactgagcaagaaagaaaagcagaatggaggaggtcaggacatcaagaaaatctgactccacctgcttccaaggggagtgggaagataaaagtcaaataggacaaggtggaaacaacccaatctccatcaacagatgaagggtgagcaaaatggggtacatacacaatggaatattattcagactttagaaggaaggaaattctgacacgctgcagcgtggatgaatcttgaggacattacactaattgagataagccagtcgcaaaagggtaaacactgtacgatttcacttttatgaggtatctggagtagtcaaattcacagagaaagaaatttagaggtcaccaggggccaggggaaaggggaatggggagttggtaataggcacagtaggagaagatgaaaaagttctggagatggatggtggtaataactgcataataacctgaatatacttaatgccacttaattgtataattaaaatggttaattttatgttatgttacgtatattttaccacaattttgtttaagtctcatagaaccttgctacgttcatgaagtgccaagttgcactgccgggaaccccaaggagaaagtaggagttagtcagtgcgggaagacgcaagcacttgtgtctcaacacgcgcagggcgcggctgcagatggaaaaaccgggaagctccgcgctgcaatgagccaggctcgcagtgaaaccatcgccaaggcaccaacgtctccctcccaacggagggtgcaaggaagggtgcctggcctcagctttcttcagatcaaactccagggggtcacctacccttaattcacacaatggtacatcacaccctgaaggggatcctgccacctgtcaccaggcaacaatgcagcctcctgacgaacaccaagctagaggaaacccaccgctgtcacctaatctgctgtcacctaatctcagacaagtaacaacttccaaggctcagggttctgaccgctaaactggagaggatggtacacacacttcacagcacgtgctaaggatgaaggatggtgcacgtgtggccctcagtgcaaagcctgagtagagaggcactaaatcaagctccactattgttatcatccgtataggtctactctcctcggttttcactttcatacatgaagcccaacagccaggtgacaggacagattgggcaggtgagagctggaagtcatcccaactttgaaaagaaaggactcttaggaaaacacaaagaaggaggcagaaaccattagaatagttaaacaatgagaatgctgagaaccaacaagctgagagaaaaagcaaacatctttactcttctttgggaattaatatctgtaaattgctttgtcttggactcatttatttttcctcctttgatcttggtcagagatgcggtccacaatttttggtggttgtgcttcatgaacacacaaccaggagacaaagataaggaaggacactttggtggggggggggggtgtctgcacatgcccatttaatgttgttttcttttacaagcctggctggaacaaaatacctttaacctccactacaccctcaccccaacacacacaggagcagcccctgcatattttcacacgtgtaactttctgctaccaccaggggatgtaaaagcagagtattttcttccaaagactgactgcctggttaacagcatttggccatactctagtaccccagaggtgacatcccattctctaccttccaacaagggtattcagtgccaggagttaaaccctgggattccaaaattctaggctaagtggcctccagccaggcacaaagagccaggcattttttttttaatagatgcagaaactgaggcacagagaggttaagcaagtgatcaaggtcacacagccggtaagggccggtgaaggaattgaaaataggccagtgaccactgtaaccagtaaactatcttgcctcacatggatcatgatcaccatcccttgtggctaggttccaggtggacttggtacagcctttggtggccgctgatgggctggtgaccctctttgcagccttctgcattctgagtgctcggggtcttaatcagccacctgagctctgactctcacctcactcagcacagcatgggttggtctcattacttacctcccatcctcctctttcaagtcattgcttgtcaagttttgcaagaatgagaactggctgtctgatcacctctcgctcttccctttgggaagccacagtgtgtctccattgttccccagaactgttcaaggcttccggtaaattctcgtatcttccctgagccatatccaattggaaggtacctacccacaccaagaaggatgccatcttgattggttcattcattcactcattcattccacaaatgtttatgctgctcagctgccaggtactgcctggccataaggagagtagaatacatggattatggatcagattcctgctctcaagtgattacactccagtggaacagataataggcaggctaacttcagatggtgatgagagctaagaagaaaataaagtgagctcaggagatggtgagtgaatctatggggaattctgtgagaactagaaggcagggtttcccaatcttgctgctattggcatttgggccagataaatctttgttggcagtgggctctctggtgcattaaaggatgtttacagtaccccgacccctacccctctatataccagtggcacttcccagatgtaacaatcaaaactgtcttcagacattgccaaatgttccctggaaaggcaacattacctcagttgaaaaccactgatcttgaatactatttaacagcacaggctctgcaattagaaccagattagaattgcagtttactagctgttaagttaaagcaaattacttcacctctctaagacttggtttcttcatcactaaaatgggttaaattttatctacttgcaaagttgttgcaaaaataataataataagatagtgtctgtggagagtttgacaagagctcaggtaacaaatgatcaataaatgggagctgtattttttaactcatcgggtcaagttaaaactcatatccaaggagtccactcttacctcatccatactcaattgcaattaaatttcccatggcacctgtccaatttgacctttctctaaatccaccatcccattggaggtagctgtcagaagtggggatcagttggttacttgacctggcatctattccatggcttctctcttctcaacagcacctccctcttccttagggaaccatgttttgctcccagtgcaacagtcaaaaggcccagataaggactgaccccacccgttactgcaagtgggcaccaatttgcataagcatcaatgattagggattgcagaactaaggcattcagcacacagtacatgacgttcctctgggtctctctctccctggctgtgagtaacaaggcatatcacccgtttgcccctgttatccatctgcaaataagagccatcttggccgggcgcagtggctcacgcctataattccagcactttgcgaggctgaggcagacggatcacttgagctcagtttgagaccagcctagccaacatggtgaaactccatctctattaaaaatacaaaaattagcagggcatggtggtgcacgcctacaatcccagctacttgggaagcagaggtaggagaatcgcttgaacctggaggttgcaatgagccaaaatcacatcattacactccagcctcggtgacagagcgagactctatctcaaaaagaagagccattttgaggctcaagacaggaggagggtgaaaacagcagctctgagagaatcaaggctgtccattacagatatgtaggttgtatcttcacaggtagtcaatacagactatcggcagctctgaagcaaattacagagaaattggacccatacgctgattgagccatacctgaagctccatccttctgaaattctaagttatatgcatcagttcatctcctttgctacctaagccatttgagttgcattttttaaattaattataaccaaaagcatcaagtgatacaacagtttaactatacaacctcggggtaacacagagtctcccaccctgcataaaatactcaagttgaaatcacttttcagtcatccattatattcactcattacaggtgctggagacagagcagtcaacaggagaaaacatcacccctaacctacttcacctgggacaatgagcgcactaccatatgctgagcttaagaaaactgtcatcggtaaatgtaccgattaaaaagaaaaaggccaaaggacactaaaacatgatctaccccaagctttcaaagttaagaagcatcaacccaacgtatcactccaaccgtgtcttggagcagctggatgtgacaccaaagatctgtaactgtcctcactatttgtggaggcactgtcttctgtgccattcaatacggtagacactagccacaagcagatagatttaaactgtgtgtcagtacaatgtaaaattcagttcctcagccacattacaggtacacaattgccacatgtggctagggaataaaatattgcacagtgtagataaagaatattccatcatcacagaaagttctattagtcaatgctgtctttccaccggagttccctttctgccttaaaagggcaagcatggtacagaggaaaaggtccctctaaattactaaaaccctgaagcaagaaaatgaacttccacaaacacatatgcacacacctagcatttgccccctagaagaacttgcagctcaaataactcaatttgtctttctattcttgactgcctcccacaatcagtgttcattcgagtgtacagtggggtctgttaccatcacttgttagataactggaagaaaggccaatattttagagcctggagcatcacacgctggacttgccacattcagccagagcacctttaaacactggattcacagagtccacacccccaggattctgatcccgtaggtctgggatggggtctagtaatccccatatttaacaaacaccctgcctgattctatgtaagtggctgttctgtggaccactctttggaggtggagtatcaggactgtgctgagcagggagacatgagtcagaatcactaataaagccacgccccggtgactataacttgaaaactctcccaggtaattctgatatactttccattcacccaaatccaatgtgtggggtactgtgttcaaagttgatgattttcttcaagaagctgtgcctgcaatctgttagcagccatcaggtgaatataagtgcctggtaacaggtgcacaggactgcaaatttcccccgcagccttttcccgaatgtctctttcccctctggaattcaggcaacagggtgactcaccatgttgtattaaaccccatggataagctccttccaccaaaaaaaagcctccaatccttacaaccagctgtcttattcccattaatggcttcttctcacaattatctttctttgggataatttatttcacacagaatatcttgagcttacatttttagctaaaatgtcgcagaaacaaattcacattgcttaagaaagccagggcctttcttccctatggcagtattttcccacggagttgaagagacatacctaggcaacagctacatgaatttttcctttgctgggcatcctattttcccgatttttctcttataaataatgacacatgtataatatatcaatattgagataacactttgtgtcttcaaaagttttctctttttaattttaaaagaaaaataaatttatagggttaataaatgtggctcatagattcaaataggcagaagccaggacatttccttggatgtaggtatccgaaacaacagtctcatctgctgtccttacactggaatgaacaattactggggatttttttccatctttgcctaaactcaagattcaaagtcccaaattaacccatagcttttggacacgtgtcagccattcgaacatggaatctcattgtctctgttacctattgccattataatgccatataattaacaatcacgaaacctcagtggcatatagcaatatgcatttatcacatatgtacctagagttcacttagggtcagctagagtgctctgctaatcctaactgaaataaaacaggtttcatatacactgtggaggaacttaactgtgcatttgcactgtgacatggctaaactctttaacaaagacgaaagcacagaaatttaacctgggatcgcccagcctgaaacaccatgaaatataagctttttgtgccacattatccttgagcattttatagtagcagaaagaagtcaaacttcacgccaagctaggggacttctgggtgctccaaaagcagtgaccacaatgaaggaagtggatcggggcatacagtagtctaaacttgaaaactctcctaagttgcatctcacatcagaagttctggattacatatagaatatcctatctaaaatttgaattcctagacagtctattggaatgttccattctgatatggaaatggagggggaaaggggactagagaaggagagaaaagacacacagtacaagtccaaaccaagtaagattttaaccctgcattggacttttgctgacaattttatagttttaatttaatagaggacctttcttggctccttgatagaaaaaaaactgcactgactaaatttctcatctgaattacctgaatccctttcctcatcctagtgcagcaaacctggtgcccgacatgaattatgcaatgcagaacaatccattatgcaggcaggaaagcaagaagggctacactggtttgcaaaaaacaaaaaacaaaattctaccatgtaatgctggcactgaaaaacagatgactaccggtcttagaggttaatcatgttctgacactgtccactcctggggtaaaggttagggtcccaatttatctatagaaaagtccaaacaagttgtattattaggaactttcctgccaaatttaaaacctccctaaatggtatacataaacttcattcgttcttgttggtaaagctacacatttcacaatcaaatcacttcagggcagagaatagattctattcctgtactaagaactcaaattcacgtgaacatcaatttcaagatgtgactttgcacccagttctaagacccggcagaccagggccctgggacaaaatattccaagaattatgatcagctgtcaaaatatgctctctccccagctcttcataacttgaattggaaagctgtcaccagctgggcctcaaataaacctacatggactataatgccaaagtagaccacttccaaaatgtactattcatttcaacacacatttcctgaccctttttgtgagttggtcagtatcctgggccctgagaatacagaaagagtaatgcaattactgcttttggagagatgaagtatgagagaaaccaagtgagagacaaatatataaacaaggcattgcaagcttgtcatctgaggaccaaatatggctcccagatgtgttttgtttggttcaccctttttttaaaaaaaagaaaactttgaaccagtgctttaaaactggcaaagttcattaaaaaaaaaaaaaaaaaaaaaaagaacaggcttctggttctcttgaaaacctgaaaaatctacactagaaacaccgggccaatgttcctacatggcagcaagaggccaaagcagaatggcagcttttcccattgaacagaataagcccttccaggtaatcctagtccccaccactccctaattgtcctttaaaatactactcagtatccagccgggcgcggtggctcacgcctgtaatcccagcactttgggaggccaaggtgggcggatcacctgaggtcgggagttcaagaccagcctggccaacatggtgaaaccctgtctctaataaaaatacaaaattagctgggtgtggtggtgcatgcctgtaatcccagctactcgggaggctgaagcaggagaattgcctgaacccaggaggcggaggttgcagtgagccaagatcgcatcattgcactccagcctgggcaacaagagtgagactccgtttccaaaacaaacaaacaaacaaaaaactactcagtttctgacttgtgaagaccaccataaataaacaattccagtagaaggtattatctttacaagtgagataagtgaaaaattacaggactctcgatatacagccagaagggatattagttaatatattctctgggggggtaaaatgatgatggataccaaaagccttaaaaagaaataattcatgtgagccaacagctttatttctagatagctatccaaagaaaatatctgaagatgttcgctaaaatgtatgtatgagggtagtcatcaatatgttatataaaagagaactgaaaacactctaaatgttcaaccttaaagtagagcttattatattataaagtaaccaaaaataaattttgcagtcactgaaatagtcaacttgatctacatatagtatttttttaaagtccatgattggccaggcacagtggcccacgcctgtaatcccagcactttgggaggccaaggtgggtggattgcttgagcccaggattctgagaccagcctgagcaagacagtgaaaccctgtctctacccaaaaaaaaattaattatttgggcacggtggcacccacctgtggtcccagctagtcagtaggctgggatgggaagatcgcttgagcccaggagatacaggtgagccaagaccgtgccactacactccagcctaggcgacagagaagtaaggctctgtctcaaaaacaaaaaaacaaaaaaacaaacaaacaaaaaaagtccatgatatgctgttaggcatgaagaaaactcccacccaaacagcatgtactgtacagtcttattttcataagaaaaagcccccccatcttcaaaagtatatgtttgtgtttctgtttgtgtatgtgtgtgtgtctgtgtgtgtgtatgtgtacgtctggataaaaatagtgttaacacatgtatttctctggggtgggattacgggcaattcggacatatttttctgccatattaacatatttctgtattgtatacattgtttaaatgagaaaaaatttaaatttcaccaggaaaatacataagctgtggaatcacagaccaattttagatagtgattgatagtcatataaggtcacgatactatttaagtttttaaaagattagaaaccaaaatctagatgcctacgctttttataaaataaaatgttaaaaaaacacatgctgcaacaccggagaaagcttttttttttttaacaacttgatcttgagttctgaattcttaactaactcacacagacttaaacaggctgatagatggaggaggaaatgaacatgctctccctatcagatgtaaattctaacgcttggccaagaatccaggtggtaaaatactatttaaaccaggccaaggtggtaccttccacggccacattacataagcaacaggcgcaagcagatgcacacatctggccagaataaaggccctctaagaccttcaacataattaattcaatatttttctctatagttcaaaatgctacaacaactggcagacaaccatcttaaatcatcacggaaaagtcagacatatggctaagtatatttaatatgctttaaaaataagacatggattttctagccaacaagatctcagacaattttttttttaattttgcctactcattaccctcaaaaagaattcaattcaacagatattcctgagtacctacagagggcagagactacaaagatccataaaataaggatgttgccttcaagaaacacataatctagtatgggagacagttgggcaaaactatagttacaaggcaccattgtgactctttgaaataatgaagtgcatggaggatagagagagggcacacgggaggaaagaatggacagtgttggtgagactgatcagagagaagaggagatggcggcaattaagcagaattgcttgaaaatatatagcagcacaccgttttttggcaggaaacactttgggaaaccattttttatttatcggactatcttccgtggggtcaccaagcatgtctctctggcagcaaaagggccagcctaagaccggtgtctctacattgacatgagggctccaggctatggggtagacacatttctttcttttttcttttttttttcttctttttcttaaaaaaagagaggaccggctgggcgcggtggctcacacttgtaatcccagcactttgggaggccgaggcgggcggatcacaaggtcaggagatcgagatcatcctggctaacacggtgaaaccccatctctactaaaaatacaaaaaatagccaggcgtggtggcgggtgcctgtagtctcagctactcgagaggctgaggcaggagaatggcgtgaaccccagaggtggagcttgcagcgagccaagatcgcaccactgcactccaagctgggtgacaatgagactccgtctcaaataaataaataaataaataaataaataaataaataaataaataaataataaaaaaagagagggtctttctctgtcacccagggtggagtgcagtggttccatcatagctcactgcagcctcggactccttggctcaagcaatcctcccaccacagcctccctccctagtagctgggactacaagcatgaaccaccatgcccctgctgtcaaggcatttctaacatggaaacctagagtaagattattggaatcagatagatctgagtttgaatctcacctaggtcagcagtcagggaaccaggagaacctgacttctcaagctaattttctcacagctgaaatgagaataagctcatctacctagacaaacccttaacctgggtttaagtgatgtatcagaggaacaataaataatagttacaattactagcatatccctcctaactcagattcccagtatcaagcatggagtcatgcctgtagaggggctttctcaacctcagccttactgacattttgggctggataattctcccttgaggggctgttgtgtacattgtggggtgttcagcagggtcccgggcctctactctctagatgccagaagcaaccctctccttaattgtgacaaccaaaaatggctccagacgttgccaaatgtcccctggggaacaaacttgcccccagctgagaaccactgattcagaggcactaactgacgtacctccatttctcagctgaaaatatcacagctggccaggcacgaaggctcatgcctgtaatcccagcactttgggaggccaaggcaggcagatcgcttgagcccaggagctcgagaccagcctgagcaatgtagtgaaaccccatctctacaaacaaacaaatagccaggtgtggtgggtgcatgcctgcagtcccagccactcaggaggctgaggtaggaggatcgcttgagcccaggaggtgggtgttgcagtgagctgagatcaagaaaagaaaagatcacagctgcttgtagggtaggtacttcaatgagcaccacttaagagccaggcagggtagtacaagttttacatacattatctcatttaatccttacaaccactttatgacacaggtaacattctcattttcaactgggagaactgatgttctgggaggctaacctgtccctggtctctcagctgggaagtgcgagagcctggatttgaacccaggcggtctgactccaaacccttatgaccactaagccccactgcttccccagccattcctgatgtaggagcccagacgtggtaccaggaagatgagaggaccacagagtcccattctcaagaatcatcgttgatggtaaaagcctgcctgaacacgcaagaactcgccctccctccacactaccacaacctgcgacctgcgaacaatcattaaaagcaattcctcaccgaggacaatgtgggagaaactcgggcaactcaaacctccgtgaggtccggaggcttccttcctacttgtctgaactaatccagtctcagcctttcaaaaaggcagcatctgaatcaagcagaaaaaagagtgttttttttctagacttgaaaagctctccagagaactgtacactgcaatctccatctctcaagagattctttcttctctcccaagggctttcaaatggggagcattcaaacaattacagaagccaacatttattgagcactcactatgtgccaagccctgtgtcatgtggtttactttctacttttccaacaaccctagagagtaggtatcattattatccccattttccgagggggaaacctggcacaaagaggttcagcatcttgccccagaacacccagctcataaagtgtaaagcctgcctcttcacccaagccaaccttgggtccaaaatctgactctatgacacatcagtaaattgctatttgtggatcattttatgagcagtactacggtcctgatgacactatatatagcagtaattttgaaacatggcttataatcagggcacgatcgccttttaattgcaccatcatgcccctgtccataaagagagcctcgagtcttgtctcataaaggagtaaagattatccttattgtaagaagcataactgtggcccattaaacagacacacaaatgcctccatccacagtaatggtggggttgataccttagccatgagaatgtaattatcttatggaactcatcttcatgacactggagatggtaacagaaaaagtctatacacacagccagaagaacctctcagtctgtttaggggtgagagagtctgcaaagttccatgacacactcagcatggggctgccttagacacacagtggtgacttgctctttaaagcatctccattggccttcttgactcactggtctcacctcttccttgccctactggaacttcctgggagcacctcccagataagccctgtgcattcaaatcctgacctagagttgccttctagggattcatgttggtggggagcacacaggactgaaagtggactgaggccaatgacttggctaagtaagggatgctgtgcacagacctatccctaactcgacaagatcttcatggtgactctagtagcctcagctctcctgtttggatcagccacctggtaccccttgttaccgtcatttcccaaatcaaagtaacctctgaaaatcaggacactcaattaattttaaagtcaaggacctcttccatgcagggaaacctaaaattggaaatgtgaccttatctctgactccaaggagactccagtggactcttccctccccttcttgacaagaaaccaaggacccacatgttcttacttgtaaacccataatactaagaccaactgaagcaggccagcaatgttcactgactttaagaatattcctggatcaatcggctaagctctattttagccccagccattgactgtaaatgttaaactctaaccaactttaatgtgatccatcatcagtcacctaaattttcagggacttctatatatctacattttcagaggtaactgacctcagaagagatttattctagttctaaacttgactgtaaacatttaacaaatacccaagcaagtactaggcaccatgcactgtttttgctactggggatactgtgggagaacaagacaacattcctgccatctcagagcttacattctagagaaagaggtaaaataagaaatttacttgtggtgaagcgatctacatactatggagtaaaataaagctgagagggggaacagggaatgacacgtggcagtggagttatggttttcaataatgtgctcacaagaggcctcactgggcaggtgacatttcagaaagacttgaagctcaagagatagcaagcctgtaagatgatcaggtgggcactagcaggcaggacagagaaagagaagtaatatccttaggacaggtcacgggcagccttggaagtcactataaggacttcggctttcactcagatacagagactacagaaatgattaataatggattattccattatgtaattactgagccataaaaagagaagatttctatttaatcataaaagacactgctcaaattacattttctaattttgctacatgccttcggaaaagttgacatccagaacacattagaccctccacaggacacttaactagaaagcagagtcaatatgataggaccaaccttgacatctgttgaaacaacaaaatgaattcataagaaatactacatcgatgccgacctccataggggagaagtctagcaatgcaccagtgtgtactagggatttttcaaggttacagatctcacatatgagctgcaaaaagacaggcaggcatgcagtaacctacttttttaggatgtgaatgtcagcccttaacgaatttgacagcctttattctcagtgtatacaaaatcagtatatcctgttacttgtatatacaaactcaaggaaagggccactaacaccagagagtggtgctttgcattaaataaccctcgtttacaaagcaacatccttcatgtaaacccttgtggtaaggagatgtcagaatgttttctcttataaaccacttaattccccttggtggatatcatcaattctgccatctaaaaccagctgggtaatgaatgccaagaaacacggtgagccaactgtatgccattgccacagaaggtcaagttaatctatttttaaataacacagccaatgacaaggggtggccactggaaacgatggacaagtgcgttgtacgtccttgcttcattttttgtaaaacctgtacagtgttccacagtgtaacctaaaaatatccttccaagagtggtcttttggcaccaagaacaaaaacaggttgatttttgaaagtttaagttaaaaaaaaaaagacataaatacaaagtacaatttaagagcgagagggctaaaattggattgtgttctgtagcaaagatctgatttgctattagccaaaaaaaaaagtacacagggacaatgctgcaagaaaacggagggaaagaatcatttttaggcatgaggacacaggtcccacatcaacaaaaaaaatcctcatcatcctgcctgctgaacatctgaaatttcacgtttagaggctcacttgttaaacttcagttagagtcaacaggcagaaatacttgaataggattcattaatccttgtcagtcatttatagcccagtataaattattagacacagaaagcctgctaattggaagatctgattacgagaaagtgaagacctctggatcctaaacaagaagtaaaagacaaatcgagagaaagggaggaaagatgttgcaagtggcctagttgcacttaccttccgaaacaatggaatagtcattcaggcatccaaccaattttagtgagcacctattatttgctgggtcttttttttgagatgagtctcactctgtcacccaggctggagtgcagtggcgcgatctcagctcactgcaacctcagcctcccgggttcaagcaattctctgcctcagcctccctagtggctgggattacaggcgcccaccaccacgcccggctaatttttttgttttttttttttttttagtagagacagggtttcaccatcttggccaggctggtcttgaactcctgaccttgtgatccacccacctcggcctcccaaagtgctgggattacaggcatgagccaccacgcctggccctgctgggtcttttttagacactgagaaatacagcagtgaacaagagagacaagcttcttgttttcatggaacttctattctcatgggaggggaaacagacaataaagaagaaacagggcccgttgcggtggctcacgcctacaatcctagcacttcgggaggccaaggcggcaggcagattgcctgagctcaagagaccagcctgggcaacatggcgaaaccccacctgtactaaaatacaaaaaattagccaggcatggtggtacatgcctataatgccagctactcgggaggctaagcatcagaattgcttgaacccgggaggcaaaggttgcagtgagccgagatcgcaccactgcactccagcctgggcaacagagcgaaactccatctcaaaaaaaaaaaaaaaaaaaacaacaacaacaacaacagaagataatacgagattgtgtcaaggctatgaaggaacaaacagggtgagggaatggcactttactcagggagctatcttttgtgtgtgtgtgtgagatgggggtctcactctgtcacccaggctggagtgcagtggtacaatcttggctcactgcaacctctgcctcctggtctcaagcgattctcccactctgcctcccgagtagctgggactacagaagttcgccaccacgcccagctagtttatgtattttttggtagagacttcaccatgttgcccaggctggtcttaaactcctgagctcaagtgatccacccaccttggcctcccaaggtgctgggattacaggtgagccaccacaagggcactatcttatatgcagtcagtggtgtgtgggggccagctcacattggcttgggaacagcaagtatacgcgtctcttcccaactccagctatgctataaatcagggtctacccactactagcactggttgttaagcattttacagcacaccagaaggaggtcactgaggagaaagaagcaagaccagagattcatgagaaaccaaacaactctgaaagacaaggccctgtgttttaaaatgagagttattgtcatacattccaatgaatcaaaacaataccaaaacaaaaaaccacacaaagaactatattcaaccatatgtgatcacaatttccctcattacagtgaggggaagggtctggtggtggtttggtttggcttttaaattgtatctcttttattatctccacactgccacacatacacaaaaagtagagggatagttacagttcctgggtaatttgaaaaaccacaaaattcacctgcaaaaatatgtaagcatgacctgtaatacaccactttgggaaactacaatcataccattttaaacctttggagtctgggtgattcatggaaacaaaggatttcacgagcacaaataacctgaagaggctcacccacttatttttggcatagagaaatgtaggctccaagaatgtgactggcagagcttattctagaacccaggtcacctgtctcatctgatgtcatcttctcaattttggtctataccctagtacagtagttcttaaaactgaacccttgaatcccttaataagcccatcagaatcccttgagggtttattaaaacaccccatggttgttaccccaccccccaaccccaaccccatcccccgcaaagcttctgaattggtagaactaaggtggggcccaggaatctggatttctaaccagttcccaggttactatactaatgccactggtctgaggacctcacttggagacctactgtcccaggaattgggagcacaggctttggaatcagacagagctgggttgcagctctactgccactgtggtatgacccttggaaaagttacccaaattctctgaacctcagcttctaacatctgagtccaattgtaaggactgaaaaagagaatgcccacgaagcatcagcttagccaagcacctattatattctaaggcaagatcttaatacatactagcgacatcttatatcctgtatcaaagtttccttaattacatttttccgaagcatatactaggacggctaaaattcaaaagacaaacaaaatcaaagatggccaaagatgtagagcaactgaaacattaataacagctttattcgtaatagtaaaaaatggtaaatactccaaatgtccataaacaagcaaaaggacaaactggtatgtgtatacaatggaatattacttagcaataaaaaaagaaccaaatgaagtacacatgcaacaaaacgaaatctccaaaatattttgttgagtaacaaaagccaaacacaaaagagtacatactgcattagttcatttttatgaagttgaagacaaaattattctatggtagatctatggtgcagggggaggggggaattaactggacaggaacatgagaaaaatttctggggtgatgaaaatgttctctatcttcatttgagtgattaacatgagtgcatacatcgcttaaaactcatcaaattatatatctaagatatgcattttactataggtaaatgatacctgaatacacataattatatataactttgtaaaggcattttatgacaaagtactgtcttccccacttaaaatgaaccaactccaacctgacaaaggactgtcttctccatttaaaatgaaccaagtccaacctggcagatccattgagtttgattcctgcacaatccagtcctgtcacagacagttttggtccatgtatctttccagagaactgccatgaagtagaaaaacagaattttctcccaccatgtagacagtatccagagtgatctgtgtccctggaagtggctaacttgggatgcaaacaacacaaaagtagtatttttctttaccatataccaagtatgagcctgcttgatatgactttaaaaggcacagtaatgaagacacattaagagcaattctgtcatacaatctaaatcatattctcaacatggaagagggagcagaaaactggtgaaatggtttctagggccatcattactggtaatgaagacgtcagaagatccaactgtgcctgtgtaattattacatgaaatagtcactttcagactgcaatgaattccaggccattcaggtttcccaatcagtatcatatttctatcccattacaagtagattcacgtacatccatccatacatacatatacacacacacacagaaacatacccacacactcgcccctgctgtgaacaatctgtgcacaaggggtgaagagagctaacacctggagacactacagtttcctttcaactcagaggtgtctgtttccaaacccacttgattatctcaccaagccttcctaaactccatgatgagagagccctgggacatcgcctcccagaaatttggcaactagtggaaggaagagacacaagcccatgcagcatcttgcacactgcaaacactgcaagccagcccctattcaggacccgttagacactgcgaggcatccccctagttgggcaggtacccttgcctgtccttcctccaccctttctccaaaatggtcctgaactgagacctgcagctgctcccatcctatgccttcacacagtattttctctacagccctatcaagtcataattatccaggttcctgacactaaaaactagtttcagaaataaatagctgctaaaatcaattcaaacataaatagctaatctttatggagcacttactatgtacaggcactgttgggtgcactttccacgtgttagcttatgtaatacccacaggaaagccagtgtgaggaagacgcattgtcaggccaggaaaggttttgaacctcaagcaaaacctggagaggtatgccaggaatgaggcacaatctctccctttaatgagctcactaccttgtatggaaatgaggacctaactcagagttcagagtaagtaaaaaagccacaaagtagacattaaaggagcccaaaggaggaagaatttgtgcatcctagcaggattctggagggcttcttggaggaggtatcccagtggagaatgaagtcataaatacaaggagctttccatagctaagtgtcagctcctcagctcccaaagctgctaaaaggccaggcgagtcggccgccccctcctccatttcatctggagcacgcctgtttccaagagaggaccagctaggcccagcccttcctttgacacattcctccagctgctgcctgtccttatggaaacacatgggaacttttcaccatgttcaacttcacgacttccttcggtgctttcactggggagaacctgcgtcatggcacttgcttgcacaagggagccctttaagggcctcagctggtctccattgggttgacatgaggacagccccttgtctgtaccaaagtgagatgtaagggacctacatcaccagcagccagcaaatgcatcttttaaaaggcctctacagatttctgagagaggaatttgcttccactccctcctcaggaatcagccccttcagtgcggtagggtcatccccccactccttcctcctccatacttaaggctctgcagcaagggctcaaaccctcgcttttggcaactgtgtgaccttgagcaagtcacttaaccagtatcaatcccagtttccttatctctaatttggggtatataaataagaacaactcgttcttagaactgttgtgaatcggagtgagatagtgcaagtaaagtattttacacagagccgggcatgtagtaaaccaacaatgaatagtagcttcattttcatcatcaataatgacgatgatggtggtggtgggagggtaaacttggacccgattcgagctaaaagcaagcaccccttccccctctccccctcccaagtgtatggctgagccacacggtggagacacatgcgtcatccggctgaggggtgaatgcaggctcttctggcggcgggctcaggaaccgccaggcagtggtgtcctagctcacctggaggggtcgcggggtgaagcagattttctgatgggggaggtccaataaactacagaccctctctttctgtatacccactcagcaggtatggaaactgactcgtggccaaagaacgccagctgcatccctcccccaaggagccaggacagcgtccaccatgcccctgactcagttccccaactctctctcgggtgcaggcgagactgcgctgcacttagtggcggagataacaggttggccagccaggcctgagaaacgtccccccgctaccttgcgcaaacccagccccctcttcgaaacgcaggtgggcaaacaaccctcaacctcgcaacaactttgtgtatttcaccgccaccacagggcgcacggcctcaacttctcttcactgcgctccgaggagggaagcaggaaatcgagaataaggggcagcccacagaccaccctccttttctcggggcgccccccaaaggcgcgccctgccttaccttgtctgacggccttgaaggtgacggcctccttgcagctgtcgatgacccccagcacgtcatagcggggcaagccggacacccggaccccctgcacctccagaagcagctccccttcgcccagcctcgggccctcgccgccgccgggaagccccgctgcctcgaccgccgccaccgctccgacgtacggaaactccccgtgctccgcgcctcccagcaccgtcacccccagctcgccctggggtccccgcttcacggtgcattcgtgaaccctgctagtccagtggttcttcttctggatcactttggacatgatgagttacacccctcctccaaaaaaataaaacgagagacaggtgccccccacagcacgagcccccaagcctccgcttgttcatgggagaaacatctctccccaaatcacaaaacaggagagagaaacttggcagcctcgctcccctgcacacgctcgcgcactcaagccatcataaaacaaactttctgggcttccccgcgagccccgcacaggcgcccgcgagctttgtttgcattccggtgcctctgggtccacgttccggcgcccgcccgtgctctcccggaccagagtccactctgcgccgctcgggttatttttttttccttccttcctttctctcttgccttttacaaatgcggtgcctcctctttgcctcccgcccggctcgcctctcctcgctggcaggctgttactgagggtgagggaagcccttccagccagttgccgggagccctgaagacgcggtggcggggcggcggggagcagggcgggaggtaagtgctcgcggcccctttaagcagatacaaaggctcggcttgttttgttacagttcattctattccgcgccgcggagcgcagcggccggcgacaggagacgcgcgcgcatgcgccccgcggccgccagccggccggcccacccctcccctcctccccgaagggagagattccaacgtgcttcccgatgggtcctaaaaccgacctgccgggagaaggcaactcccccccaacccttcctgaacccctatcctctctccttttctttcagtgccctggactccgcggattcctttggggctggagggccgcacacgtgttttactccaactgtttgcaacttttgaaacccgggcaatctggctttggcatttgaaaaccatttcaaacaggtgggggttggggaggctgccacactcaccctggcgctcacactcacgcacacgcgcacgcactcgcgccggccctaagcctcctaaccgccctcggccagtggctggccaggctgtcggtcacccagcccggctggttcgccgccccccttgccgcaggtcccactgaaacccccgagacccgccccggggcgctcgccgcctccctgcctgccctgcgcttgcgggttcgggtcctggcgcggggtctgccagggtctctgcgacccgggggagggggacggtgggatcctccggttccccaactgggatccctgtgcgggtcacacgcgctcttacacacacccgcatccttaaactttgggaccaactttttaggacacgggaaactacaggcaagagagagaagccatggtgctagtgtgggttcaggtattcaaccaaaaaagagatccctctagcttttcaactgccctgccagcagagactgctggacccagtcaatcatctgccccggcctcaagttcctggcagggccgagaagcctgcggacctactccggggccaggagataaggatccccgccgggcgcggacatgccctgcgtcctggcgcccgcgggggcgtgagagaactcggaattcgcagcccgggggtagctgcggcctccggaggtcgcccgggggtgcggatggagtgacttctgtcccggcgaggtggcggacagaaagactcccataccacaggaaggctgcccttcccaaatactcctcaaatcaggctgctgagtagtctccccagcagtttgttttcctctttagtgatgtataattttgttcatctttggtcacaggagagattccaagaaatgaggggggtacgttgaaacgatgaagaaaggatggacacagcagtcgaggttgagaggtaggctcaggggtccacccttgtgtgaccttgagcaagcttggtgacctccgcgcctccgtttctcgctgatcaaataagtagaacaagacctcacagggttcttggaagtattacgtgggaaaacacttataaagtggcaaataataaaaactcattatattcttaatagtagtattactatttgggaagaaaattgggaaatcatttggggattcaagttagtaagtatgataatttatcctctcctttctagaacttagaaaatatgggcatactttgtgtgtttgttttttgatggtggtggtggtgtttttagaaacgtggtcttgctttgtccccaagctggagtgcagtagctcgactagctgattgtaacctcgaacttctggactcaagcaatcctaccacctcagcctcctgagtatctggaattataggcacatgccaccatgcccagctagttttatttttttgattttttgtagacatgggggggtctccctatgttgattgcccaggctggtctcaaactcctgggctcaagccaacctcctgactcagcttcccaaagtgctggggttatagatgtgagccaccatacctggtttaggcatacgtttaaacatccttttaaagcattgtagggtgctattctaagctaataaaagtaaggagggatgttgatgcttctctcttgggatatccagaactgaaaatcccattgcattgttgtgtttctgaaaaaaggaggtgaccaattttccatggctttgcttggtgagaggaactttgtctccagctttttttcagaagcaatctaggtcaatatgaacagcacttcaaaacataaattatcaaacccgagcacagatccagccaatcagaatgtcaaggaagggctaagtcatttgaacttttaaggttccccttatgtgttgttggtacacaacgctgagcaccataggtttagtatcttgattccaaagcattgtttgggtcccagacctttttgtcaaataaacctgtgatccacatctctgtgtaaaataaaaactcaaggaggtcaggacactttgacagtttggtttactgatgtattattcccagttcctagaatggtgcctcgtactagcaaatgctaaaatatttgtcaaatgactctttccacaaaaatgtacatttttactttccatgttagtggggagtcacagattcccctgcaaatcattagtaagcttagtaagcttagccttgtgtgtttccccactttgccacttcatattctagtaaagtgtaattgtttgctaagaatacccacaaccaaccttgaattaggagtcccctacctctccactcaactctcacctctgcctgggggagtccaagggctggacaagaccaggcgttttgtgattcctcccaatgcaacaacatccccctcttgccaggattccaggtgtcaccacagcagctgagaaaggaaagaacttggaatttagcatacgtcaggttttagatgtggaaaagccccaaaagaaggagtagtacctgtgggcacagagggcaatatggagagaatagacattattctaattcaggaaaaggaaaaataatttgaaccttcaaagtagccaaggctgccagtttccaggatgctccctctgcatcttcccggctggtgtttcacctggtctagttcctgtgtcccagactggagaagttcaaggcagagatcatctctctcctatccaacctttgaaacctcaataccaaaaaccatgaaccatgccttgtgtggagtgtgcaccatacacagttgttgagtgaattgatgaagtgtgacatgaaattgttgaataaatggatgaagtatgacatgaaattgtgtaatatgtgacctttgatccaaagccagtttagatttggttgccaaaacaggggtatttatattaggttggtgcaagagtaattgcaggttttgccattactttcaatgaaaagagcttatagttatgtcattgtgaagtagatttttcctgaatagatctaagatcctagtattctgacttgtctcactttagctatgaatttggcaatacattctgttgggagaaataatgctataaaatacctaactttcaagcttactgtatatgtcagcgtagtgatgtgagttgggggtttttttgtttggtttttgtttgtttgtttgtttgtttgttttgagacaaactctcactctgtcatccaggctggagtgcagtggtgccgtctcggcacactgcaacctcagcctcctgggtttaagtgattctcacgcctcaacctcccaagtagctgggattgcaggagtacaccaccatgcccagctaatttttgcttttttagtagagacagggttttgccatgttggccaggctggtctcaaactcctgacctcaggtgatccacctacctcggcctcccaaagtgttgggattacaggcgtgagccatcgcgcccagctgatgtgagttattttatgcaatcaccacagttgtgtaaggtaggaactatcaggaatgaccttgattttataactgaggaaaatgaagctaagaaagtgaagaaacttgccccagagcttacaagtaacaaaaccaggaagtgaacccggaggcatgacccaaaacccatgctcagaacactgtagtctgagaggataggatgtggccatttagcatatttgggtaacagcatgctctggactcttgaatctgctacatagtgtatacacagtaattaagtccccctcctttctgtctcttcactttaagctaaaggatacagtgtttcactccagaactcaatctcctgttctccatctatgggctttgaagattcaaataattcaggaatgcaaagagaattaatttgcaaacatttctacagtgtttaggctgcagtacaggtgacatgccaaacagtcttatattattgcataagcatttcaacaatgaactcctaatacagagggtagattcagctgagaaataaactataacagaataaacactagacaaattaagatcttatttgtatatagctagttctactagggggaagaaaaaaaaacgaatatgaaatgtgcatttctttcccttctccgaaatatatttctttccaaagttttccagttgtgattaaagaaatgtgtcattgcagtttaaagtggtaattttcctcctttttctgaaaatatgaggatgggaaataagttggtcagttgcaggggcaaaggaggacatataaattggttatttttttaatttctgaagaaagctatcaggaggcatacattagaggttttagtataaataggttatatacggtagggtaaccgactccaaacaggtaactcagggcagaagaccagtaggggagattgaagccagggtagcttcctctgaccatagtattcctccctttagtactttcagctaagcaagaaaaaataaaatgttgtactttggcaaaccaaggtggatgatcacttgagcccaggagttcgaaaccagcctaggcaacatggtgaaaccccatctctataacacatacaaaaaatttgccaagtgtggtgacatccacctgtagtctcagctactcaggaggctgaggaaggaggattgcttgagcccagaaggtcgaggctgctgtgagctatcattgcaccattgtactccagcctaggcaacagagcaggaccctgtctcaaaaaataaaaataaaaaacaaaataagtctgggcacagtggctcacacctgtaatcccagcacttcaggaggccaagacaggcagatcacttgaaatcagcagttcaagaccagcctggccaacatggtgaaaccccatctctactaaaaatacaaaaattagccaggcgtggtggcacacacctgtaatcccagctactagggaggctgaggcaagagaattgcttgaacccaggaggtggaggttgcagtgagcgaagatcatgccactgccctccagcctaggtgacacagcaagactccatttcaataaataaataaataaaatattaaattgtgtgacaattgtgtgacttttcaagacatcatatatgaactattattttaatagccctggaagtaactccaggaagggtttaaatcctggttaatgttctgtttcacttaagtgcaaaaaaaaaataaatcttgggaactggaatatttggttagacttttggtctgaggaaccaagggaaatcaaaaaatgtatcacgagtatctctcctaaaatttcccaaatggttcagctatataaaacactaagtatctcaaattatcctatcatcctccataattccactgaaactatacctgatggtttactaacacttaatttccttgagaacaggaaactctcattttcccgagaacagacgtgtgtacctcttttatattgtctcccatcaactttgtcaaaatatggtaattagaacatggcttactctatatttctttttttcttcttttttttttttttttttttttttttttttttgagacagggtctcattctgttgcccaggctggaatgcaagatcacagctcactgcagcctccacctcccaggctcaagtgatcctcccatctcagcctcctgagtagctgggactgcaagtgtgagccactacacccaaccttcctcttctttattgtatatctttatcaatttactgtaccaaaacagaactgagagggagaaaaaggaaaatacacattgaaactaagggtaaaatgcccatatttttaaaaataccatactaatataaatttttgcaagaaatttttaaaacagacaagtaaacaggcacattaaattaaatcatttgtaatcttaccaccaataattaaccactttttatatttggtgaatcttatactggacctacatgaacttgcatttattactttcaataattgaataatattttattctctgaatgtttccaaatttatttaatcttaatagtccattgatgattaggattctgaagaaggctaaaataacaatttgtattagggtgtttttgattgtcagagacagaaacccagtttaactaccttaagcaaaaaatgaaatatattactccatgtaagtggcaagaccagaggtgaaactagttttcaatatgtctggatgaagaggttcaagtgacatcctcagctttctctctctctctgtgtcttgattctcctttgctgtcttgccctcaccctctcccactacatacagatgggtcttctccagccagccaggaaagatagctagctacaagcagcctacatgatccaggtttagcaatcccagccaaaaggagattttcactaacaggagggaaaaggaatagagaaacttcagtctctaataaagcaatttcagttgttgagggtagaggtagagtctgcctgctttgcggtggcttccacaataaacacgagtgattcaaaaacctcatcagctgcctaatcaagcctggcagagtgtttggggctccttagggaaacctcatcgaggtgggttcctctgcagactcttatcatggtctccttttctgcagttacctaaaggttccacgaattcaagtatagtgggagtttgatttcaatcaaagctgcagtggttggcccatatttttatagatgttttgaagatattctaaagctggcaacactgcaggattgaaccccttacaatggaagccagtcaagtgttatacttgtttaatacagatggctcgttaaactacataacattgatttcaaatgtcccaaaatgagtcttgagtttctctgaggctaaactgaaaataacaattaaatatcccatgatggcacatgacagttggtagattgtttttattcattcattcattcattcatttagcaattttttttttttttcttgagacagagtctggctctgtctgtcatccagactggagtgcagtggcgcattctcagctcactgcaacctctgcctcttgggctcaagccatcctcccacctcagcctccctaatagctgagtctacaagtacacaccaccacgcctggctagtttttgtattttttgtagagacggggttttgccatgttgcccaggctggtcttgaatggtcttgaattcctgggctccagcaatctgcccatctctgcctcccaaagtgctgggattataggcatgagccaccgtgcccagcccagcaatttttgtttgttttgagatagcatctcactctgtcacccagactggagtgcagtgacacaatcatggctcactacagcctccaactcctgggctcaaacaatcctcccacctcagcctcccacatagctcagccacaggcacacactaaccaacctgtctaatttttttattttttgcagggactgagtctcactatgttgcccaggctgttcttgaactcctggcttcaagccattctcccgcctcctcctcccaaagtactgagattacaagtgtaagccaccacatctgacttttttttttcctccaagcaattctcctgcctcagcttcctgagcagctgggattacaggcacctgccaccatgcccagctaattttttgtattttaatacagactgggtttcatcatgttggccaggctggtctcgaactcctgacctcaagtgatccacccacttcagcctcccaaagtgctgagattacaagcatgagccagcatacctggccacagctggccttttttttttttttttttttttttttttagcaattattgattaaacacttattttgtcaactccttgtagggactgatggcacagcactaaaagacacttcccccccaccccaacccccggaggaagcctacctcccaatttgatattgaaacaagaaaaaagatcagtacttggtaaggtcaatgacagggaaacccaggttaccgtggaggacatctcattagggaggattttaatttgtaaacatggcattagaaattaaaagtgccattgttagaagaatttcttgtctcctctcctctaatttattttacaagtattttgagaagtgaaagacaaagtccagctttatgattacattatgatactcaaagatatgttttatggaggcattcacagagttctaaggtggttaaagttgcccacgatgtgaatatatagttccataaaggacaatgctatcttgccacaaagctgatccagcaaacactaggtggggttttgaaaaatgactcgggataacgaagcaatctggagtctgagcaaccttgctccttgaactgtgccatctttggaaaattggcccccaccaaactgtatagccagatgaatgaggactcagaaagataatgtattactcactttccagatttagcacgttcctagaattttaaactcatttttatggactgttgcctaactgaggggagacttagacaaacccagagtggttatgagcaacatccccgggggagtcagtgcccaaatttggagtccttgtgtcctgaacattcctgacactcctggcttggatattcagcctgcccgagttggagtaccccagggattttagatgcagctgagaactgctgaattaagccaagtgttggaagatcctgcaattttcattattaagttagccctctgctttattgaatgcacaagctggcatatgcttgggaatgtttctgcttccaaactcacagcatctacatttttcagatgtttgaccttgatcttgtgaccttgcctctagaactctgagagtgctgggaatactcacagctgagtgatggaagcaaaaactagaaaacaatctttttttcttttttaactcacttacaatacagggttacctggcttgagactagactgttttagactagacttaccttccttaagttattaattttatcatataatctcagtatgacttcactttttgaattgataccactaaagcctgaaactattaaagctatgcaatctgcttgctaaggcaagctggtatttcctgatactgctatccagatagctgagaaccttctctagagtcatgtttttcaaacttttctgattgctgtttgcaataggagatgtatttttatcactagcacacacacacacatacacatatatacatatggttgaaacaaacttttcatgaaaccataattatcctttctgggcctgtcacagtggctcacgcctgtaatcccagcacttcggaaggccaaggcaggtggatcacttgaggccaagagttggagaccagcctggctaacatggtgaaaacccgtctttactaaaaatacaaaaattagccaggcgtggtggtacatacctgtaaacccatctacttgggaggctgaggcaggagaatcgcttgaacctgggaggcagaggttgtagtgagcctagatagtgccactgcactccagcctgggcaacagagtgagactctgtctcaaaaaaaataaaataaaataaaataaaaattatcatttctgcctacaatgccctatgccaggggttacaacccatagtcaatccattccttaacctatccctgtctgactcatgagctaagaatggctttacatttttaaatggatgaaaaacaaatcaaaagaagaataacatttatatggagacacatttacaacatggcatgcactgctacaaatctttgcatttactgtcacattaaatctttacaataatttgtctttgtcttaacaaaaatcatgaccacaatagcaacaatggctaacgttttttgagggagtgctcatggtgctgagcattttggtaaatgcgttatgtgatacatgtatttaatcctctgcaccctataaggcagggagtattagcattcccattttacaggtgaggaaacagaggcttgataaggctatgtaacttgtagagcatcacaaacctaggaaatggcagttggggtttgattctaggtttttctgcttctggttcaatgattttgactactatttaccttggtagctccttgccaacttgacccacaacatggactcgatgaatatttgaaaaatgaatgaatacatgcgtgaatgaatgaaggaccttgagatggaatgatggtcttccatggatcctaaacaactatgagaacacagacaaattaggtgattgttctgtgcttttaaatgtaggctgagcatggtggctcatacctgtaatcccagcactttgggaggccgaggcaggcagatcgcttgagcccgggaggttgaggctgcagtgagccatgtttgtgccactgcactccagcctgggcaacagagcaagtctatctcaaaaataaaatgaagtaaatgcaagcaaacaaagtaaacatctcatttattgagtgtttacaatgtgcctaacactgcacataagtgctttcaatgccattctcatttgatcctcatgacactataaggtagatgctatccctgttttacaaatttagaatgaggttcagagaggttaagtatcttgccaaagatgacataaccagtattcagacctgttgtcactgagactaaggaccaagaccatgttcttaaccactgtgctatatacttccatttattaatttctaacatccctgtaatatctaccctatggttttaaggcaaaataagcaatattgctagagccttcattagtaattatagtgtgagccaggtacagtggctcatgcctgtaatcccagctactcaggaagccaaggtgggaggatcccttgaggccaggagttcgagaccagcctgggcaacaaaaggagaccctgtctctacaaaaataaaaattaaccgagcatggtggtgtatgtctgtagtactagttactcaagaggctgcagtgggaagatccctagagcccaggagctgaagaatgcagtgagctatgatcacaccactgcactccagcctaggtgacagagtgagacaccatctctaaataaatatataactatagtgtgctccaatgacatgtttctctatcaaaaaatttaaggcctaagacagaagaagtggaggaagcatagagataccttccagtacattttacatgaggattgtgttactaacatactgttatataatctttgcagattttctataaacctaagacttttctaaaattaaaatttatcttaaaacactctgaagcccatgaaaaatatgttcaacatcattagtcattatagatatgcaaatcaaaatcacaaggagataccactatacatccactaggatgagtatattttttttttaaatgagaataacaaatgttggtgagaatgcaaagaaattgaaaccctcatacattgctggagagactgtagaatggtgtagctgctgtggaaaacagtgggcagttcctcaataagtcaaacataggattactgtatgacctagccattccactcctaggtatatatatatgcaacagaactgaaaacaggtgtgcaaacaaaccacttgtacaaaaatgttcatagaagtaacattcacaacagccaaattcagaaacacccaaatgtccctcaatggattaatagataaataaatgcggtatatccatacaatgaaatattattcaaccataaaaagaaagaaagtactgatacatgctcaaacataaaacaaccttgaaaacattggtgagtggaagaaggaaaatgcaaaagaccacatattgtatgatcgcatttatatgaaatgtccagaataggcaaatccacagaaacaggaaatacattagtagttgtcaggagctgaagacaggaggagtgaggatggtgctccttaagggttatgggatttattttgggaggggattaaaaggttctggaactagacggtggtgatggttgcacaacattatgaatttattaaatgctactgagtcatatactttacaatggttaaatggggagttttattttatatcaattttacctaaaattcatttaaaaaaaaagaaaggccaggcacagtggttcacgtctgcaatcccagcactttgagaggctgaggcgggaggattgcttgtgtccagaagttcaagaccagcctgggcaatatagtgagacctgtttttttaaaatatatatatataataataaattttaaatacatatatattttttgagacagagtcttcctctgttgcccaggctggagtgcagtggtgcaatctcgactcactgcaacctccacatcccaggttgaagtgattctcctgcctcagcctcctgagaagctgggattaaagttgcctgccaccacgcctggctaatttttgtagtttttagtagagacggggtttcaccatgttggccaggctagtctcaaactcctgacctcaagtgatccacctgcctcagcctctcaaagtgctagccactgtgcccggcctaaaataatttttaaaaaaccactctggcaacattacaaagttgtgacatattaaaataatatagaatgtggtatataatataaacatataacttacagaaaataaaaatattatagtgctcagaacatcttgatttagagcatgggtttttttgtttgtttgtttgtttgttttgagacggagtctcgctctgtcgcccaggctggagtgcaatggcacgatctcagagaatctctttaacctggaaggcagaggttgcagtgagccgagatcatgccattgcactctagcccgggcaacagagcaaaacaatgtctccaaaaaaaaaaaaaaagacttgcctgaggatgtctagacattatgtgaaagcacagggctttgattctgccagttataaaagcccatgctcagccaggcatggtggctcatgcctataatcccagcactttgggaggccaaggcgggtggatcacttgaagtcaggagttcaagaacagcctggtcaacggtgaaaccgtgtctctactaaaaatacaaaaatagccaggtgtggtggcgggcacctgtaatcccagcttcttgggagggagcctgaggcaggagaatcgcttgaaccaggaactcctgacctcaggcgatccacccactgcagcctcccagcatgctaggattacaggcctgagcccagccctcagagaagtcttataacctatatcagctccactgtcctcaaccataaaatgagtatgattgctattattatgaaatacttttcacatgaggtgtcatttagcctaacaataatgatgttgatggttaatatatagtttgttcctttctttctttctttgtgtatgaattgagtgttgctaatcttcttagtgataactacattaaaagcaaactgatctgggtttagggagataacaatcatattttgaatggcttttatctccttgagaggcttcctacatcccagaaaagtattgtgtgaatagatctttaaagtagtttccaaaggagtatagcaatgtactataactattatatggcattatgttgaaatttaggctaaattgttgttactaaaatttctaggctgattccaacctgtttccaagaacagctatggaattcggaggtgataggaaaaactttattaagaaaaaagatacctacttctccttcccttcccctgaggataactaagctgtcaccatgaatactaagactgctatttcttcttgtatttgcatatggcatcctcccaggtaatttatggagcaaatcctgacacagctccaggagaaaccatatagctcctttagtatcattagtaagtaaaagaccagaacatgtaaagagggagaggaaattcatctcccaaaagattcaggcacaaggctctctgttccataccctctacagtccctccacccacacaactcagacattgtatgtaagagaatgacacttctagaaccctgccctctaacctctgctcctttttttttttgctctgattctcctgggagttgaggaacgctggaaaataactgcagggtttggcttccagttggttaaccctgatgctgatttctctgtgggacattttcaatctctgttcttggcaagaaactgcagaactacaaaaactgccagctgaatgaaaatatgttgaagagcaagggggttgggagagatggaaatttggggagtgaagggtttaacactattcccattcctgtttgtacattctagtctaaccaccaactgtaagaaagtttgactgacatttgacctactggattaacatcatcaaaagggctgaaaccctctttctttttatttttttatttttttatttttaatttttgaaacaggatcttactctgttgcctaggttggagtgcagtggcatgatctcagctcactgcaagctccacctcctgggctcaagcccaggagatactcccacttcagcctctggagtagctgggtttacaggcctacaccaccatgcctggctaatatttgtatttttagtagagatggggtttcacgatgttggtcaggctggtcttgcactcttggtctcaagtgatccacccgcctcagcctcccaaagtgctgggattataggcttgagccactgtgcccagccccctctttcttattccattctaccttacgtgactcctccaactaggttaaatgtcttgtatttgttttagcagcacgtgtacgtcctcatgcaggcattcccaaaatatttgcaaggcttatcatgtgccaatttgctacaccttaggtaatgattcgtcctttaattcaataaatatttattgagcacctaagatatgtcaggcacttttgaactagtgggggaaaagcccttaactaattgggcaaaggcgttcttctcatggagcttacattctactgtggcaatacacaaagtagaaaatagagtctctgaagataggtgctatggagggggaaagggggacttttgatgcccaaggttaggattgttgttatgtacaaggtgataaggggaagcctcgtggctaagttcagaactgagcagaggtttgaagacagtgagagtgtggatcaagtagctatctgggagacagtgttctgggcagtaggatcagcaagaaccaaggccctgagatgacagtctgcttggtgtggcatggaaaagcaaagtggaaaacaataggcaaatactcttaccctcatggggcatagagtctggctggggagacagatagtaatcaaatatctgcctaataaatgtctaattctaaagggactgtgtgccaagcggaaaatgcagacatggctggaagacactataaagacacctgatcgaatctgagggaagtattcccttaggaaatgtagtttcaactgaaatccagagaagaagaagtgattaatatggtactggaagaggccaggcctcccatagttttgggattacaggcataagccactgcacccaggttccttttttttaaccaatcatcctcaatattaaatattatttttagtatgtatttcctaagaacaaggatatcctttgtgtcttgtgacaagagacaaaataattgagcaggcattgaaagccctcatattctcagaaaagtaggtttttccagcagacattaaacatactcctgcaggccaggcacagtggctcatgcctataatcccagcactttgggaggctgaggcaggaggaacacttcaggccaggagtttgggaccaacctcgccaacatggtaaaacccatatctactaaaaatacaaaaattagctggccatgggatgtaatccctgtaatcccagctagcagggaggctgaggcacgagaatcgcctgaatttgggcggcagaggttgcagttagccaagatcctgccactgcactccaaactggttgacagagctagactgtctcaaaaaaacaacaaaagaatatggtactggaagggtgtttcccttatagagggaagagtctttgttcacaggggtgaaaagaaacagctctagttttaggaaataaaagatccagtgtctgacttgcagagaatgaggggggaggcatccttgaggagctgaaagacaggagcaagggacaaatcacacaggatttcttgcagtttgtatgtagctgtttaaataaatatgtttgccgtctgccttccctgctggaccaagctgggcaaggggtaggggggcagctgggaccctgtcttgttaactactgcatgctaagtacctactcagaatgtggcacacagaaagggcacagtttgtatttattgactggctgactggctgtctaacaactcaaacaatctgacataaccatctgaaagcctcaatagtgaaaatgcagcttgcattttgggagtagttggttctgccagattccaggtttagaaaaggccagcaaattcggcagtattcaaagctgtgatttctatttcaaaaccacagatagaagctgaccaggaccatggggaactccttccgtgggggaaaggaatccaaatgggacattcatgatactgagttggggcagggtttctatcttgacttggtgattgtgcatatcatagatgggtgctcctttgctcatttaatactttgtattaataagtgaaatgaccacatggtaaaacagtattcttttttctttttcttttttttttttttgagatggagtctcactgtcacccaggctggagtacagtggcatgatctcggctcactgcaacctccgcctcccgggttcaagtgattcttctgcctcagcctcccaagtagctgtaactacaggtatcgggggaaattcagccagatatcaggcaaaattcacccctgatatttcacgtacgttgttttctattttccctaagtgtcggccagtttgagaaataaagggacagagtacaaaagagagaaattttaaagctgggcgtctaggggagacatcacatgtcggtaggttccgtgatgccccctgagccataaaactggcaagtttttattagtgattttcaaaaggggagggagtgtacaaatagggtatgggtcacagagataacgtgcttcacaaggtaatagaatatcacaagacgaatggaggcagggcgagatcacaggaccacaggatggggcgaaattaaaattgctaatgaagtttcggcatgcattgtcattcataacatcttatcaggagacagggtttgagagcagacaaccagtctgaccaaaaatttattaggcgggaatttcctcgtcctaataagcctgggagcgctatgggagtctggggcttatttcatccctacagcttgaccataaaaaatggccacacccaagggggccatttttgaggcccaccctcagggacgcattctctttctcagggatattccttgctgagaaaaataattcatcgatatttctcccatttgcttttgaaagaagagaaatatggctctgttccgcccagctcaccggcggtcagagtttaaggttatctctcttgttccctgaacattgctgttatccttttcttttttcaaggtgcccagatttcatattgttcaaacacacatgctctacaattggtgcagttaacgcaatcatcacagggtcctgaggcgacatacatcctcctcagcttacgagatgacaggattaagagattaaagtaaagacaagcataggaaatgacaagggtatccattggggaagtgataagtgtgcatgaaatcttcacaatccatgttcagagactgcagtaaagacaggcataagaaattataaaagtattaatttggggaactaataaatgtccatgaaagatttacaatccacgttcttctgccatggcttcagccggtccctccgtttcatgttcctgacttcccgcaacatacagggaagtagtcccagtactttggggggccaaggctggtggatcccttgatgccaggagtttgagaccagcttgtccaacatgacaaaactccatctctacaaaaatacgaaaattagccaggtgtggtggcgcatgcctgtagtcccagctactcaggaggctgaggcaggagaatcacttcaatccaggaggtggaggttgcagtcacctgaaattataccacggcactccagcctgggcatcagagcaagattgtctcaaaaaataaaaataaataaaatatgctggttggttgtacttgtaatgcagggacagaggcacccttcattctgcacagtttggtgatgatggtgtaggtacagggcctggtggggtggggggcgactttttttttttttttttttttgccaccaagaggggatccaagcctggggacagtgttaatttagaggaggccagattgaaagaattgaagagaaacaggggtcaagcctggaatcaaatcacatgtgaagcatactctgcttctagacttttctgctaggtaaggccctagattctatttattgtttaaattggaacttctgtaactggtatccaaattgtcctagctggtaagggtgatagaaatccagaaacagttctgtgcactctaaaaatacagcagcatctatagaatatcagaatgagggtggaattgctccaagatccatcttcttttaagttgttttgtttttaagtgaaatcttccaagagtttatcccttaaatataaaaatgaaattttgactaagtaaaaatatgtgtgtttttttagaaaaatgccaaccatacaaagaggtatacagtgagaagagggtatccatcctactcatctcagttcctctctccaaaggcaacagtttagttgttgcacatttccttgtgtgtactttctaagatattctgtgcatagatcttccctttaatttacacaaatggtactatattaccgttgctatttttgctcagaaatgtatcttagaggttgttccgcatcagaaaatatttaagctgcttcttaaacagggcaacatgaccaaaatttttcattcttcattttattgctatgaaccctacctgtaaatgggtggtggggggaatttgtttaatcagtgaaatgaagcaacagcaacaaataccttctcaggtatctgaggaagtgtacttaaaattattaaacagctgcaaactatttcattttttggttctgtaatttatttaaccaagctcctacagggagtcatttaggttgttaactttttttttttttgagatagggtcttgctctgtaacacaggctggagtgcagtggtgcaatcacagctcactgtaacaggaactcctgggctcaagagatcctcctgcctcagcctcccaagtagctaggactacagacacgcaccaccacacccagctaattttgaaagatttttatagagacagggtcttgctatgttgcccaggctggttttgaactcctggcctcaaacagtcctcacactttggcctcgcaaagtgctgggattacaggctgtaacctttagctaccatatacaaagctgcaacaagtgttgtacatgctgctttgtttgaaagctgtatcaactcttctaaacaatagcctatgtaaacacaggctgttgaaccaaaagttttaaatttgagatgctgagtagaagaattcaaaaactgggtttggttgcttagtttttggcatataaccctcttttctcctacaaatagatagatttctttttctcattcattgatccatccattcatttatcaacaaatattttggggcagtcagtatgtgccagggagtattttaagtgctgattgttacctccagggcctaatatcacatgcttatttaagaagcaggtgataggtccaatgaatgtctagtcctctgtggttatttagacctattaacacaagccacgcaacacataacaatgtttcagtcagtgacaaattgcatatacaacattggtcccattcgattttagtactgtatttttactatacattttctttctttctttctttctttctttctttctttctttctttctttctttctttcatctttctttctttcctttctttctttctttctttcgagacagggtcttactgtttcctatactggagtgcagtggtgtgatcatggctcactgcaacctccacctcacgggcttaagcaatcctcctaactcagcctcccaagtagctggaaccacaggtgtgcacctccacgcccagctagtttttttaaaaaaaattcatcaagacaagaacctcattatgttgcttagtctggtctcaaactcctgggctcaagggatcctcctctctcagtctcccaaagtgctggggttacaggcgtgagctaccaggcctggcccattttctatatttagatatgtttggatacacagatacttaccattctgttgcaattgcccagagtgctcagcacagtaacatggtgcacaggtttgcagcctgggaacaacaggctatcccataaaacctaggtgtgtagtaggctgttccatttaggtttttgtgagtgtactctgcggtgtgcaaaaaatgaggaaatctgctacctgtacatttctcagaacatgaccccctcgttaagcgatgtgtaactgtacttaagagactgcctatgagagttttacagttatttcagtactcaatcttggatgtgtaccagaagggggtcatttctatgcaagattattcaatacttttaagtgaaaaaggcagtatgagcccaacaaatgtatcatttattgagcctttactctatagagatagaaagcatttaataactaactagatgttatctcaggaatggaagtgagtcctatagtttgttccttaattcattgctacaatattgtttattttgtgcttttaaaaaatatttaatttcctcttgatttttaccaacaagtatgtaagaaccaattttggctcagtatttgccatttttttctacagttgcaatattccatttcatcatgtaatcctcaaaaatattaaaactctgagaaaataagaagcattgataagaaaatgattctgaactcttcctgtggcctagatgcatggtttctgacaaattaatgtgttattaaaataactgacctatgagaaaaatctgtgatcacattcattacaaccagaactggaaagatctattagaaattgatttacatcaagcccatctttataatcccttgtctcattctttactttctgtttatgcctttgccaaactttaaaatgaagtatttggctgggtgcagtggcttacgcctgtaatcccagcactttgggaggccaaggcaggcggatcacttgaggttagtagttcaagaccagtctggccaacatggtgaaaccccatctctactaaaaacacaaaaaattagccaggcatggtgacacacaccaataatcccagttacttgggaggctgaggcaggagaaaagtttgaattgaggaggcggaggttgcagtgaactgagatcgggccactgtactccagcctgggcaagagagcaagactccatctaaaaacatttaaaaataaaaacagaaaaataaaattaaatacttaatcgtgtgattgtttctcttgtttctccttgactggactctgagcttcatgagatcagtgactgagtctatttgtctatccgttttctctctgtgcctaacacatggtaggtgctgaataactattggtggaatttatttggccatgtgcttatgattcaaacatactaaggtaaaattagtttgtttaatgaaattaaactgaaacaataacatgacaaaaattgagtaaaacaagccaggcatgggggtgcacccctgtagacccagctacttgggaggctgaggcaggaggatccagaacccaggagttcaaggctgtagcgtgccatgattgtgcctctgaatggccactgtgctccagcctcagaacagaccgaggcctcatctcttataaaaaataaagccaaacaataattgaaaataaaatagctaagttagtcacccagtgaaaataaaggagaagcaacatggctaggcctatgagtttctttattttttattccattgataggaacatttcctgcagccaagggaaagtaaattcatttgtttaatgggcaaaatgaggcaaccaccttcatagacttctgaggaaacaggctaaaatgattgtgctctgtataatatcaaagaaatgtgagagaacccataataaaaatgacagtctgatacacccaaatgacccctttcatcttaagaccttgagacgttttgcaaatgataattgtctcttacatcatctccatgaggtaagaattttctctccatgtataactgagcctacacaaagttatttcttttaaagtcccaagtcatggctggtatttgaatccttcacctcctgagatatgtgtaagttagcatataaatcacattgttaaatgaggaaaaaactttaaatcggggcaaagttatgtttgaccaatcaagagtctaagctcattagggacttcagattacaagcaaaaattccccaatgatgaagagaaataggaatggactgggggaatttcaggataaaaacctgttcagttttaccttatattttaatgacattttcaatatttggatggcctaagagatgaattgacttcaaaacacattctggaatggcgggtgacctggtgccaaaataaagaatatctgaccaagtatacattcccaggggaatgataataaaaccctagactgggagaatgtttcattttattgcccaaattcatggaaattcaccatggcggatcaaacttttaatatttggtcacaatgggacatcattcttaatgatacccagctgcagagggtgtgtgctcggaattttcattcctacctttgtgctattaggaatgctgttttttatatgtatgtaatttttaaacttcttttcataaatcattacaagtgtcaagaaaaattataagaatagtattaaaaaactctcacatccctttttcatagattcacaaactgttaacgtctgcctatttactttgtcatttgtcatatgcaaaactttcttttttttttttttttttttgagatggagtttcattcttgtcacccaggctggagtgcaatggcataatcttggctcaccgcaacctacgtctcctgggtttaagcgattctccttcctcagcctcccgagtagctgggactacaggcacatgccaccatgcccagctaatttttgcatttttagtagagacagggtttcaccatgttggccaggatggtctcaatctcttgaccttgtgatctgcctgcctaggtctcccaaagtgctgggattacaggcgtgagctactgcgcccggctgcaggtaattaaatattgatcaatatttttattgaatctaccatctatcctccaattttgtcaattgacccaaaaagaacttttgttgcattttttttcttcagtacagaatccagaccaaggttgcatgttacatttaataattatgcctcctttgattttgatcagttcctcagcctttctttgtctttcatgataatgacatttctgaagaacacaaacctattttaaaatggcttacatagactttttttcaagaaacctaaatttaatggttgttgccatttttcagttaacagttttcaatggtaactttgtaagaaaaggagagatgagaattacatagcttttgactcagtactgtcactgaagtccataataaatccacttgtatatatgatttttttttgtcgggggggatggagttttgatcttgttgcccaggctggagcacaatggtgcgatcttggctcactaccacctccacctcctgggttcaagtgattctcctgcctcagtcttccgtgtaacttggattacaggcacccgccactacgcctggctaatttttgtatttttagtagagacagggtttcaccatgttggtcaggctggtcttgaactcctgagttcaggtgatccacccgcctcggcctcccaaagtgctgagattacaggcatgagccactgtgcccggccacatatataatgttttaaagcagtgcctggcacataggtacgtctcaataaatgtcctcaagggtacactttttctccctcccatcaccaactctatgctccctgtgagtgaggggcacacatgaatcttggtcattttatcctcagtatctaatacaagggctgacagtagattgttgaatgaatgactaccccaggggtgaggaagtgtcctcagatgtgttaaatgacagcatctcttgttttcctttcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccacctcggcctcccaaagtgctgggattacaggcgtgagccatgttttcctttcttttagagacaaggtctcaatctttttgaaatggttatttacttttggtgtattttctagtgttcattaagtcttccacattttcttacaggattatttgtctttttattactgatttataggagggttttttttgtttttttgttttttgttttgtttttgtttttttaagagactttctccccggctggagtgcagtggcaccatcatagctcgctgtaactcctgggctcaagtgatcctcctgcctcagcctcctgagtggctggtactataggcacatgcaccaccacgcctccctaatttttaaattttttaacagagacgggtcttgctatgttgctcaggctggtctcaaactcctgggctcaatcattcctcctggaagcttggtgtcccatagtgttgggattacaggcataaactgctgcacccagcttccttttttaaaaaaatcatcctcagtattaaatattattatttttagtgtgtatttcctaagaacaaggatatcctttgcgtcttgtgacaagacacaaaataattgagcaggcattgaaagccttcatattctcagaaaagtaggtcttcccagcagacattaaacattctcctgcaggcagggcacagtggctcactcctgtaatcccaatactttgggaggccgaggcaggcagagcacttgaggccaggagtttgagaccagcctggccaacacagtgaaaccccatctctaccaaaaaaattaccaaaatattagctgggcgtggtggcacggctgtaatcctagcttcttgggaaggtgaggcaggagaatcacttgaacctgagaggcggaggttgcagtgagccaagattgtgccactgcattccagcctggcaacagagcgagactccgtctcaaaataaaataaaataaaataaacatactcctggaaataacattttgtttactctccaaatgcttaaaatcctctgacatcgtatgtattctgttgtattttttccttaggtcattttaaatataattttcttcccttctcttttcattccttctctctacattttaggataccgaaaactcattaacttcgattctgctaaattaaaatttgtggagtttttgagcaattctttgtcctctaaatatgctaagagaattgtgaaaaactaagcatttgtaagggtgccaggctagtctacttaaggaaatcaatagtgctttgcttaggctttatttacatataagtggttggttaatggcaaatcgctgtatactgttatttagttaccatttaggggacccttactgtgtttctgtgtacctgctgtaatcgccacacatcagtgtttcaacaacaaacaaggtagttgatgctcagagagagtaactagcccaagatcagacagctggtaagtgattcagctgggatttgagcccaggcctctaaattccacctttgctagatcactctgtgccagactagtttgatgtgcatatgcaggcccttgtccttacagttcttgccttacagcccttggtaggcacattgaacatgtacttagttaccagcaaagcaatttcacacacacacacgcgcgcgcgcgcacacacacacacacacacacacactttcctgaaagcacatcgacaaaaataaaaaaaagaaagaattaaatatatgttgtttcaagaaaatcaatgatgtagtattggcgggaaaactacaactttggccttcttttcaggcagcttttattttactttaggttttttttaattgtttttgttgtttgtttgttttttgagacagagtctcactcagtcagccaggttggagtgcagtggtgtgatctcagctcattgcaacctccacctaccaggttgaagtgattctcctgcctcagcctccctagtagctgggactactggcatgcacgaccgtgcctggctaatatttgtatttttagtagagatgggggtttcaccatgttggccaggctcgtctcgaactcctgacctcaaatgatccacacttctcggcctcccaaagtgctaggattacaggtgtgagccactcataatcccaccgagcctggccataagggggattttattttgaaataccaagtagggtatgggcatggccatcagaacctcgtcagtctttagagccttttgaagttctaactccagccctgggtcctttaaaagtaagaaaacggcatttcatttaaaaatattattttcattgcttcagggaatgcttccctcacattgagttaatgagcttttcctgaaaaattcggttgtgagagattttgcttttgaattacccaatgcagagcacattctgagtgattagaggggctcctaagataaaaggaatcacctgacagaaaacacactttggtgcttaggaagagttgccaatggaggagaatttgggggcagcattactttctgacttttcatggtttatatttggtcagctaaggatttaattatttcttcatattctgataaagtgcccctctgaatacttaatagcccactctggctacttgatttttatttctttaaaaatccttttttttttttttttttgttggttgggtggggtggctcacgcctgtaatcccagcactttgggaggctgagatggctgaatcacctgaggtcaggagtttgagaccagcctggccaatatggcaaaactcaaactctactaaaaattcaaaaattagccgagcatggtggcgggcgcctgtaatcctagctactcaggaggctgaggcaggaaaatcagttgaacccaggaggcaaaggttgcagtgggccaagatcgcgccactgcactccagcctcggcgacagggcgagactccatctcaaaaaaaaaaaaaaatcctttttttttttttttgggagaagagactgggaggagcatgaaaggaattttgttaacttatttaaggggagaaccataaaactgtctatctacccatattttttatattccttttatataatgtgtataatttactgttcagaagtatgattggtttcatttaaatcatatgcattttctaattattgcttgcctcaaaaattatgggaaagaaaagtcctgagccatttggcacttcacctatataaacagatgaatgagtgttttataataaacatgtgcatgtttataataacaagtgagattgtcctgataggctggtagcagtaaccacaccgaatatttgctgagtagttgctatttgcaggcactatgagaagcacttcactcacctaatccttacctcaaacctcagaagcagttactgctattatcctgttttgtagaggaagataatgagcctcattaagattacttgtgagctaaagcccccacagctagcgatcctattcagtccgacttcagatgctacactttgtttgggatcagtctctgttgtcaggatggagaattggaagggcactagaaaggattcaggaaaccacagaaggacctgttgcagctgtctagctaagagatgatggaagctgggactagaattttgaaggtgaaagtataaggaaatggagggaaatggttaggtctcggtaatggctttgatatggacatgaggaagaagatgttattgagaactgggtttttgtttgacatggtggaggaaaaacatccatcaaaacttagcctgattccttattagagaaaagccagtcagaattagtggaaggtaaggaatgaagacacattttaaaggaaacagtttcatgattttcaggaaaaagaaccgggctataaaatgatttccaggtctgccctgagcacttgcgcaataaagagttagaaacggtgtgcaattggctgggcgcggtggctcacgcctgtaatcccagcactttgggaggctgaagcgggcagatcacgaggtcaggagatagtagccatcttggctaacacggcgaaaccccatctctactaaaaacacaaacagaaattagccgggcgtggtggcgggcgcctgtagtcccagctactccggaggctgaggcaggagaatggcgtgaacccgggaggcggagcttgcagtgagccgagatcgcgccactgcactccagcctgggagacggagcgagactccgtctcacaaaaaaaaaaaaaaaaaaaaaatggtgtgcgattcaagtatcacttggatcgcaaatggtgcttctcaagtgtttgaaggtgattaaaagcactttgttttctaagccgtttaaatattccctttggaaatcttgttaaactcatttgcttcccaaactctttctctttaaaaagaggaaaagataaacttcagctgagcctctgtctcaatgaggctttactcgattagaaaatattgaccagctgcattagcccgtgtcttcttctatggtcaatagagttactttccacaggcgctgaatctgcaatccacaaagtcttagctggtgttaatgaccgtttcagtgactgctccagctactattttgcattctgccaaataggctgatgggaagagggtagggattaggggcagagtctcatcccatgccttgggatggacaacaaatcccagatcctggaaccatattgtggtaaagatatttcccctaacacttgaatacctattcatgctagacttctgaatgtattacctttagtcttcacaaccattagacaagaatattttattttgtccattttgcaaatgacagaatcaaaacttcagccctgcatatccaaatgtctgctggccctctttacctgtgcatcatactagcaaccatccaaacaactaattatattctttttttttttttttttgaggtggagtcttgctctgtcacccaggctggagtgcagtggcatgatctcagctcactgcaacttctgcatcccagtttaagtgattcccctgcctcagcctcctgagtagctgggattacaggcatgcgctactacgctagctaattgttgtatgtttagtagagacagggtttcaccatgttggccaggctggtcttgaactcctggcctcaaatgatctgcccacctcggcctcccaaagtgctgggattacagctgtgagccaccgcacctggccaaacaactaattatattctttccttcctcctgttattgatatgacagcagccatctatgattagaaatctaggctcattcttgattcctcctctctcttaacctaaatagaccctatcaattgctaaattttaatggttttcctcctactacgtctgtattaggttttttggttttccctttgtatttgtttactatggctgctataaaaaataaccacaaactttgtggtttcacacaacacaaatgtatcctcccacagtttgggtggccagaaatctgaaatgagtcttacaagtctaacatcaaggtgtcagcaaagctgattccttctgggggctctaagggagaatccatttctgtatcttttcttttctttttttctttttctttttctttttttttttttttgagactgagtctcgctctatcacccaggctggagtgcaatggcgtgatctccgctcactgcaacctccacctcctgggttcaagcgattctcctgcctcagcctcctgagtagctgggattacaggcacttgcgacaccacgcccagctaatttttgttatttttagtagggatggggtttcatcatgttggtcaggctggtctcaaactcctgacctcaagatccgcccacctcggcctcccaaagtgctgggattacaggcgtgagccaccgcacctgggcctcgtgtcttttctagttcctagaagtcacctacattccttggcttgtggccccttccttctactacatcactttttctctctttgcttccgcagtcacatgacctatttcctctcctacagttaaatctcactctgcttccatcttataagggcaattgtaattacatcttgggcccacccagatacttcaggataatttccccatctcaagagccttaacttaatcacatctataaagtctttttgccatgtaaagtaacattcacaggttcaagggttaagacatggccatccatgggggttatttttgagcctactacaacctcctagcctggttcactgtgtcccaatctctcacctcctagctggcctccatacctttagtttaattcatattccctcctcaacccatgatttacagcagtggttcccaaaagcaggtccataaactgaacccttgggaaggttgttaaaaatataggtgccaggggagggttagaaggggtgagggattaaaaattacctcttgggtatagggtacactgctctggtgaggggtatactgaaagcccagacttcaccactatacagtttatccatgtaacccaaaaccacttgtaccactaaagttattgaaattttaaaaaaagatatcacctagcagaaaaaacaaaactaatcacatgattctgttcattaataccccttataatcttctgttttgcttctgcatatgtgaccaatataaacatttttatgttaaaaacaaaaaataggtgcctgggctctacccctatagattctgattcagaaagtctagtggatctatgctttataacttaccacctggccaggcccagtggctcacacctgtaatcccaacactttgagaggacaaggtgggagcactgtttgagcccagggtttgagatcgccctaggcaacacggtgaaaccctgtctctaccaaaaaatcagccaggcgtggtggcgcacacctgtagtcccagctacccaggaggctgaggtgggaggatcacctgagcctgaggaggtggaggctgctgtgagctgtgatcacgccacttcactccagcctgggcaaccgagtcagatgccatctcaaaaaatagagtaaacgaataagcaaaactttacggcatgttgaaagctacagaattgctatagagaagaaactcaggatcggaatttgagagagtgacccataggagaattaccataaaattgtctgcataacaaccacactgcttttacgttgcctcttacagatcaacaaaaatagcaaagttttctatttctaaggtgtttttattcatatattacatagttttaaaacaattgtgttttaaattagaagtagctttcagggattgatgcaggttagtgacgggagagagagaaggctaaaaccttcctgctccacatcccaccttattatcctattgtttttctcatgcccagttagttttggggacctctcattctgactataaacttattaaggacagagattgtgtctcattccatatataatccccagcacctaggacactggtatatcgttggcattcaattaatgtatattcaataaatgttcaattaatcgatgaacaaatggaataaatgctagtacaaaagactttgttggctgtgcatggtggcttacacctgtaatcccagcactttggaagccgaggtgggtggattgcttgaggtcagaagttcgagaccagcctggccaacatggtgaaaccctgtctctactaaaatgaaaaaaattagctgggcatggtggcaggtgcctgtaatcccagctacttgagaggctgacacaggagaattgcttaaacccaggaggcggaagttgcagtgagccaagtttatgccaccaggtgacagagtgagactcagtctaaaaaataaaataaaataaaataaaataagagtttgttgagttgttactaaaagacaacctacattgatgagaacccaagactagggattaaaggatctcttggttttggtggcaaagatgggtggtttgcttggcctaggagtttgaggccagtgtgggcaacatggtgaaactctgtccttacaaaaaccacaaacattagctgggcatggtggcatgtacctctagtcccagctattcatgaggctgaggtgggaggttcacctgagtccagggaggttaaggctgcagtgagccatgaccacaccactgcactccagcctgagtggcagagtgagaccctgtgagcatttgctgttgaagagtgtacagatgcctgtgatgcaagcctaaagtgaacacaaacacttctaggcagtcaaaagccaagcagacgtacattattttgtatctgtctagatatgggatatacagataataacaaacacctgagaagcacttactatgtcccaggcactgttctaagcactgcacatgtattaacatgtatgtgtatcatctcatttaatttttacaagaaccttaacatctcatgaaaattccatcttccaatgatgaaataatgtagttaaataacttgctcatggtcacaaagttagggagtggattcaaacctgggcagcctagttctaaattaggtaacaagagaaagtaaatatgctgagttgtataactatcatcataacacaagctagaacattgtcgttaccccagtaagaagccacatgcctgattaagttaatccctcttcccacctccagccataggaaatcactaatctactttctgtctctatagatgtatttttccgatacatttcatgtaaatggaatcatacagcatgtgctcttttgtgtcaccttctttcatttagcatattttgtagattcatccatgttgtagcatgtattcgtggtttgtttttttttttttgaggtggagtctcgctctgtcacccaggctggagtgcagtggcatgttcacagctcactgtaacctccaccttctgggatccattgatccttccacctcagcctcttgagtagctgggactacaggtgcacagcaccatacctagctaattttttttgtgtgtgtggagacggggtttcaccatgttacccaggctggccttgaactcctgagttcaagtaatccaccaatcttggcctcctaaagtgctgggattacaggcataagccagtactcctggccttctttcctttttatggctgaataatattccattgggcagctctaccacattttgtttacccattcaccagttgatgcatatttgggtggtttccactttttggctatcatgaataatgttgctatgaatattcatgtacaagattttttgtggatatatgtttttatttctcttggaatagattcttagaaatggaattgcttgatggtatggttgttttgtttacttttgcttatgtttaatgtttaagaaactatggcctgacatttaagccaagatctgaaggctgagaaaatacaagggtaaaggaagggaaaatgttctatgcagtgagaaaaccactagtttctgtgtttcgtatgtggtatctacaaagaaataattattgtattttgtgtctaaaaccccacgcaaaatagtgttatcaaaggaaatctgtccatttcttatgatgataaatgtgcctacatcacagccaggtagcctttccccaatgtgaactgaaatattctatgagaaattgttacaaaaacaaaatccaaactaattaaaaaaaaaaaaacaagacaaagcaagcaaacgagcaaaaccccaaactctggccctgttagtcttacatagagggttgtatgctaaaatgtccatgactattccttctattctgtcttcttctgtttcagcaagtttatcacgtcaatgcagagcaataatatttgcagtctgaaagcctcagctctgtttgcattgcttcccagaataatggtgttcggtgaaatggaggaaaataatcacactcaagccatgtttttccaatatgctttccccctttttgtcaaattgtgttaaggttttgtatgtatgtatgtgttttccctttctatgtgcttttcagtgtgagacagagcaagtattcatgactctggcagttcagcccgtcggttgagtacacaatacattggttaatccaaggtgacctgcgggttgaaactccgtttgcaaaggcagctgcagtacaaccaccaggcaattacgacattataagccatgagtgtaaagctagagagataacttctaaaaggccccaaagagtttttacttcttaggcttatgaccagaaattcatggcacattaagttttccatctgaaagctaggagaatcccttgtcacaccttctaacttctaagacattgcagagagaaaatgtcaggatttctctggatgaaaagtattctccaagtatagtgataaaattccagcttcttctctgtacttttaagattaaataagagggagggaggccaggcgcagtggctcatgcctgtaatcccagcactttgggaggccgaggtgaatcacctgagatcaggagttggagaccagcctggccaacatggtgaaaccccgtctctacaaaaatacaaaaattagttgggggtggtggtgggcgcctgtaatcccagctactcaggaggctgaggcaggagaatgccttgaacccaggaagcagaggttgcagtgagctgggatcacgccactgcactccaacctgggcaagagagcaagactccatctcaaaaaagatactcaataaataaataaataacagggagggattggtggtatatctggggctatggtttggatgtggcgtgtttgtctccaacaaatttcatgttgaaattggatccccagtgaggtagtgtggggaggtggggccttgtgggaggtgtttggatcatggagacagatataacagttcttgctctctcaggaatggattcattctcaccagattggttgttataaagccaggatgattccaggtttgatccatcttcacacgtgtctggtgcccatttgactttctccaccatgttttgatgcaactcaaaagcccttactagaccaggagcagtggctcatgcctgtaatcccagcactttgggaggctgaggcggatggatcacctaaggttaggagttcgagaacagcctggccaacatggtgaaacgctggctctactaaaaatacaaaaaagttagccaggattggtggtgggtgcctgtaatcccagctactcgggaggctccggcgggagaatcacttgaacctgggaggcggaggttgcagtgagtgagatcacaccattgcactccagcctgggcgaaagagactccatctcaaaagacgaacaaaccaaaacaaaagcccttaccagaaactagggagacaccagccctgtgctgcttatgcagcctgcagaactgtgagctaaataaacctcatctttataaattacccaacctcaggtattcctttatagcaacacaaaacagacaaagacatctgcttagaggacagtagtggccattgttttcatcatccgcttaaaattcttgcccctgtcttttagaaatggccagttggttttcctttgtgtaataatgacattctcaaatttgtttgatttggttgatctgactccactactatgcaccgtgggtaggcacatgacgcagacctgagtaactggagaaaggcatgtccctgttcacagtgattggctcagaaatgggcatgtagcccaagctgggatcatgagaagcctgagcttttgctgaaagagtcaggagaggtaccctctttcctgtcggttgtcaggctgctactaaacatcttctctggtgcaagggggtgccctgtctgtaacaggagagaataaagcaaacagagaggaaagcaggacccagagatggagaagaatagtggcatcatctcagaatcaggagccagctatgctgacacctatacagaccttggaccatttgactttaagccagtaattttttctgtgttgtttggatgggaggaagttctgctacatgcaaccaaaaaaattctgacaaatttaggggccacccaaagctcagtgtagtgccagaagaaaatggattttctccctatttttaacccccaactttgtttttgtttgtttgtttgtttttgtttttttgggacggagtctcactctgttgcccagtccagagtgcagtgacgggatctcggctcactgccacctccgcctgctgtaacccacaactttgaatcaacataggaattccaaaataatctcatcacatgaagttggtttcaggatgtttttgctttacctatatataggtgccatacataaaaatctcagcaggtagccaggcacaacagctcacatctataatcctagtgctttgggaggtcaagacaagaggatcgcttgagcccaggagtttgagatcagcccaggcaacacagcgagaccccatctctacaatcaaataaaaaaaaattagccaggcatggtggggtgtgcctcttagtcctagctcctcaggaggctgaggtgggaggatcacctgagcccgggagtttaaggctgcagtgggctatgatggtgacactgcactccagcttgggtgacagagggagaccttgtctctaataaatagataaataaaaacttgacaagttaaaagtgaaagaatcccagtgactcgtgacctaaaaaggtaaagtaactgtcccagggccaaatgttgtattatgattgaagtgtcatggtatcagagccttctactctctttcattatctttagtgaaatgggtttcaaaatctaatattgtacacagaagtggttttaaaatcaacatatcaattaccaaataatgatcaacttaaaaaagaagtaaaataggatccatagcatcagaacacatcacatatcacttcttggccttttggctaagatctagtgcagaatacatcacatataataaggataagtaatattttataaagtttgtttccatggtatataaacataaatatatatgcacatacatgtagatatccatggagtgagtctgatatgtatgccgtactttttaactgtggttccctggctaagcttaaaagcttctttcgtgcatacttggatttcctttataaggatgttttcatctaaaaggaaaaaaaaaaagtacatttttcataccagtaaagggtcacctggcattccagtcaagctagcccacgtggatggcctggattctaacaaagtttctgtgcctgagttatgaacacaacatttttctgtttgtcttccacaccactgagctaccagtaacaagagtgtgcttttggaaggcttttgggattctttggggaatgaaagtgctgcataaaatcaagtctggtctgtttatggatgtaattccctgtgcccagagatcaggatgtgcactgcggtctgaattacattgcatctgattctcattaactgcctgtgattttccccctggatccggtttctctgccttttctgaattactgtgcacatggctggcttccgcagattgctcagccctggtcatctgcaattgagtccactgctctgttataacccatgctgcaatttgagtggacccatatcagaagtgttttaggcataaacattctgtctaatgattaaagggactccctaagctaaatgctgctctttagagagtttattaccaatcactatggaaaagggatagatttgatttcttaagcctggagaaggaaagctggacaataagtgtgtattaccaaaccttgtatgatgctgtcggctgaattgtttcctcctcaaatgcatatattgaagcactaacccctaatatgattgtacttggagggaaggctttgaagaggcaattaaggtcataggaggtcataagggtggggtcctaatgcaataaaattggtggccttctaagaacaggaaaagagaaagatcttgctccttttccacatgtgcaatgcatgcacctgaggaaagaccagcacatagtgaggtggccatctgcaagcctgggagagagccctcactagaacctcatctcaggcttccagcctctaggactgtgagaaaattcaggtctgttgtttaagccacccggtctacagtgttttgctatggcagcctgagctgaatgatagctagcaagcaaggcctatctcaatcttttttagtaccaggaaaaggttgcagatttcttattaacctaataaataagtatatagtgcctactatgtgccaggcatgttctaaatccttaacaattattaactcttgcaatcttcacaacacactcagtcaggatgagctaagttatgctgcagtgacaactcctggatttcaatgtttagaacctcatgtgtatatttctccctcacagttgtctcttccttggatctggtaggagaaggtaggataggggacccttttacctggaaatgacacttcccttgtgctcacttttctttggctaaagcaagtcacaggcttcctttaactttgaagatggggaagtgctatcctgccatgtttctggaaggaagagaaccagacacatttgttgaacagcaaaaatgactactgaaaccattttatgaagaatatgcttttgctgttcctattttacagatgagaaaacaaacacagacagtttgtgtaacttatcctagatcacaaaactagtaaacagagtcaggttaccaggcttagcaaatcaaaatacaagacactcagttaaatttgaatttcagataaacaacaaataaatttttagcagaaatatgtcttaaatctgcatatgggatatatttatactaaaaaactatttgttgtttatctgaaattcaaatttaagtgggtgtcctatattttatctggcaaccctaagccaggcaatcctcagccaggatttgaacccaagtattttggcttcagagatgaatattcagagatgaatattctattcaatactgttcttttgcttctgcaaccttcttttgttcctctgctgatgttaatttaatatttgttcctgaaccatatgaataaggctgaaagcaaatttgaggtcttctctatgaggatggggataaagagcattttggaaatgttttcccactgatagtttcacgtagagtcctgggagctggggtgcgggggcctgggggtataggaggaaatggaatctctcctgtaaaagtgaacctgtccactttcagatgtgtctagtgatctgcctcctaatgtttcttagctaatggaaggggaaatgtggggcagataatcaaaatgacagttaatccccaaaactttcccctgtaactttgaagtgtggcatgtttgccttttaaattttgaggcacttaggctgataataaaattagtttgcattctctgaccacagtaattgaggattcaggcttgaggagttggctccacaccagtggtagacagtgggcatataattatgtatttgaaatgaaaaagaaaattatgtatgtgaatagggtgagtctgaaggggagtgtaaagccagcttaagaccacatttttcagttattgtcccacaaggttgatagtcgatatgcaaataagtgtttacagtgataatagctgatacatgattaacatctaagaaatacttattaattgcctggcacagagcctggtataaagtagaaattaaatatttgttaaatcaatgaatgattgacaccctataatgtagatgctctccgttgccctattttacaaatgaggaatcggaagttaggctcagtgaccatctgattaaaatcagtctatcttcttctttttcttctttttttttttttgaaaccaggccaactgctaaagatctttgggcctaggcaagaactttgatttatctgagaattagtctgcagagttcctagttcttgattactacttctcttgatttgagttggccttcaaagagtttgaatcaagcagctgaagcttgtgactcattccctctattaggaataatggctaataagcaattaggaagaattgattaacatgtctgagcccttggataaaaaaatagctaagtatagaagattaacatttcattgttgctatgtggcctgagtttcacttaattccctgcaaaaggacacagaatctttccctagatgaggtttcaaagcaagggccagtcatcattcagtattcaagggggattggttctaggaccctggtggggagtaaaatgcaaggatgctcagtccctttaattaaatggagtattatttgcatataacttatacacatcctcctgtatacttttttctttattttttattttttaatgagatggaatctcactatgttgcccaggctgggcatgaactcttgggctcaagcaatcctcttgcctcagccccagcaaagtgttgggattacaggcgtgagccaccacacccagccacatcctcctgtgtactttaaattatctttatattacttataatacctatccaatgtaaatgctatgtaaataaagtcaaacatcgctttataatggagataccttctgagaaatgcattagagtatttcctcattgttcaaacatcatagagagcacttatacaaacttggattgtgtagtctgctacacacgtaggctggatggtatagcctaatagcctgttgctcctaggcccaaagaaaccaccttctctgtgaggcctattatgaagactaatttcaggtattaacattggagatccctcagtacccccttattgtgtgccttggtgcaagagccaaggaaaaggaaagtaaatgaaagtctgaagaaactgtttttggacaagaggccaacattgacatgttcctttggctatttaataaatttcggcgacccactagggatatatgaataagctgggcatacacaccccatagactttaacagagtagcagaaaataacagttagtattaatttctattgaaaatccttttatttagtcattactatatcccaggttctgtcctaagttatttatcatgatttcatcttttaactgtccaaacagtcttgtgggctgctctaacgctgctggtgggtacacagcttggtaatgccactttggaaaactgtttggcagtatcttccacactgagtgtatgcaaaccctatgacccagcaattctattcttccgtatatactgagcagaaatgaatacatgtgttcaccaaaagacatgttctagaatgttcgtagcagcactgctagtaacagccccaaaataggacccacccaaatgcccatcaaccttgattgattaatcgattgatatatatgtgtatatatatatatatatatatatatatatttttttttttttttttttttttttttttgagatggagtctcgttctgtcgccaggctggagtgcagtggtgcagtcttggttcactgccaactctgcctcctggactcaagggattctcctgcctcagcctcccaaataattgggattacaagcccacaccaccatgcccagctaacatttatatttttagtagatactgggtttcaccacgtcggctaggatggtcttgatctcctgaacttgtgacccacccgccttggcctcccaaagtgctgggattacaggcatgagccactgcacccagccaattgactgatttcttagttgattgtgagttaattaaaaggcacattattctgagtattctgagtgggcctaaattcatcatgctggagcccctttcgaaagggccagtaacttcacgtggagggatttccctgctcctctgaagtggtgatgcaaaccgcctacggagaggagcgctcagcaaggaaccgtggggccctttagcagccgagcacagacattagctgacagtcagcaaagaagtgggaaactcagtcttaggaacacaaggaatcaaattctgcaagcatctatataagcttggaagaagaccccaagccccacatgaggatgcagcctggctgaccccttgaattcagccttatgagaaccctgagcaaagaatccaggtaagccatgcccagacttcagacctgcaaaaactgagacgataaattaatgttggctggatatagtggctcacacctgtaatcccagcactttgggaggctgaggtgggtggatcacctaaagtcaggagttcgagaccagccagaggaacatggcaaaaccctgtctctacgaaaaaataaaattaaaaaaatggaaaaaattaggccaggcacggtggcttacacttgtaatcccagcactttgggaggctgaagtgggcagatcacctgaggtcaggagtttgagaccagcctggccattatggtgaaaccctgtctctactaaaaatacaaaaattagcagggcgtagtggcggacggctgtaattccagctactcaggaggctgaggcaggagaattgtttgaacctgggaggcagaggttgcagtgagccaagatcatgctactgcactccagcctgggtgacagagtaagagtctgtctcaaaaaaaaaaaaaaaaaaaaaaaattagccaaaccaggcatggtggcaggtgcctataatcccagctatttgggaggcttagggaggagaattgcttgaacctgggaggtggtgattgcagtgagccaagatcatgccgttgcactccagcctgggtgacaaagcgagactctgtctcaaaacaaaaaaactaaaaacttaccaaacaccacctttttctctaagatgatatgtaaaactctttcatgtctcaaattctttgcatatgcttaaaatgatttttattctgcaactcctaattgagaggtagttgtttccttgtctttcctactcattaaaaaaatctatacattataactagtttaactatcaacctttaaaagggtaaataaattatggtattgtggtatattcacacagtggaacactctgcagcaatgcaaatgaatcatctgcaattacatacaaaagatgagtatatttcacaaacattccatttttatgaagtttgaaaaatactgttagacactgggtagtggttagtcttaggggatggtgaggcaggcagaattctaaggtgggggacatgatacctgccccctaggttgctccctcatataatccctgtcccttgagtacaggtgcaacctgtgacttagtggggtatccctcctgttattaaggtccctaatcactgaggagactatcatgggttgacctgtcctaatcaggcaagctcttaaaatgagcagttagaggtcagagacagaagtcacagtgacaaacaaggtgcttctggcctggaagggacccacagttgtgacctgtatatgggggcaggaaccacacagcaaggaactgggcagcctgtaggagctgagagtgggcccctgccaacagctagcaagggagctggacctctgttatacagccataaggaactgattctgccagcaactgcaacgagctcaagtcctgaatgagaacccaagccttggctgacaccttgattgctaactcgtgagacctgagatctatctaagctgtgcccgcactcctgacccatgaacactgagataataaatctgtgttgttttaagctactcaatttgtagtagcaggttacattgcagtagaaacgtaacacagagggtagggatgagaaggaggctactgggtattgagagtgttctgtttcttgatctaggtgatggtcacacgagtatatttaatttgtgaagtttgtattttacacttaagatgtgtacacttttctctatgtattatacacttgatacaaagttgtttaaaaatgaatcttttgaaataggttgtgtgttataatctctgctctacagttgaggatatggaagcccagagacacccaagcccagatctgcctgatttcactgtgctctgtggtctctattgtagcctacccctcttgttgatggtcagataatataactatccccttggtggtgctactctttgtaaaacactaaaaaaacaaaaaaggggaggggagtaactcttcagaatgagtcagacctttgatatatgtcgttttgattattcagggagccctgataataattgcagtcattttctagtggtgcagtaagggacctctgataaatgtgaccttttattgctgtccatcgcccctcctccttccagggaccggcaacaaatatatctactaaagattctgacttttgaccctgcctgtcaacaactgagaaggaaaggagaaatagagaggtaagagttcacccaaggtgtgtttgttcaggaaaaagtatttattacaccagcattttctttaaaaaaatgcaacaaaccaaaaacctagcaacagtctttcaaagattaccaaaataatattaattaacaatcatttaaacagaatcaaacaacttcagaaattatgcacctaaaagtttaaaaattatcctccttaaaaataacaactactgccgggcgcagtggctcatgcctgtaatcccagcagtttgggaggccgaggcaggcagatcacctgaagttgggagttcgagactagcctgactaacatggagaaaccccgtctctactaaaaatacaaaattagccaggcgtggtggtacattcctgtaatcccagctactcgggaggctgaggcaggagaattgcttgaacccagaggttgcggtgagccgagatggcaccattgcactccagtctgggcaacaagagcgaactccatctcaaaaaacaaacaaacaaaaaaccccacaaaaacaaaaaactgcactatcccatacagtagccaagtgtagatattgaccacttgaaagatggtctgaattgaaatgttctatgtaaatacacagaggatttcaaatacttaggaaaaaaagaatgtaaatatttcagtgtcattatattggttatatgttgaaatcataatttttagacgttgggctgcataagatatattattaggaactagaaaatacaaaatttcatctgtgactcattacatttccttttggatgcattaatctagtatattgtaggttcttcacaaaagacatatacaaagtaaaaaaactagggcttaaatttttttttttttttttgagatggagttttgctcttgttgcccaggctggagtgcaatggcgtcatcttgcctcgctgcaaccttcgcctcccgggttgaagcaattctcctgcctcagcctcctgagtagcttggattacaggtatgcaccaccatgcccagctaattttgtatttttagtagagatggggtttcaccatgttggccacgctggtctcgaactcctgacctcaggtgatccgcccatcttagcctcccaaagtgctgggattacaggcatgagacactgtggtggcctagggctttcattttatagcatcattattagtttggttttgtttattgttgttttaagagatagactctccctatgtcacctaggctggagtacagtggcacagtcatagctcactgtcacttcaaactccagggctcaagccatcctcccttctcctcctcctccaaaggattacaggtgtgaacccctgggcctagcccattatttgtttgtttattgttgatgtttttgtttgtttgtttttgaggcagagtcctgctttgtcacccaggcaggagtgcagtggtgccaacatggctcactgcagcctcaactccctagtctcaagcaatcctctcaccttaggtcccgatatagctggaactacagatgtaagccaccacaccaggctaatttttgtgttttttgtagagtcagggtttcaccatgttgcccagttggtctcaaactgctgagctcaagcgatcctcccgtctcagcctcccaaaatgctgggattataggcatgagcttccatgcccggcctcattacttatttttttaattatcttttttctgattacaaatgtatcataacatagtaaaaactattggaaacacagaaaagcatacattagaaagcaaaagctctcctttaagctgaatcattttaattaacattatagcctatattcttataaaatatatatataactacatactgtatatgattcattatataaacattattttggctaaatctatcatggagttctttctataataatatgtaggtagatagttcactatgtaaatgtatttatttacccaatctcttattgatttaggttgagttttttctttcttatgaaaactgccattgctactgatgatcccatgcatacatcttttggtacttgtttagttatttccttaggatccattcctaaaagtagcattcttgggtcaaaaaacagagatgacaaattttagattcctacagtgccttgttagtttgtgttttactcttaacagtaagctctcaggcttagggaccatttatttttggtgtattgtaccctgcatggttgtgggcagggatcatctcttataggttcccctctcactccccacttccatacccttttcagcttttgaacaagttgagactaaaagatggttcaggttttgattctttttttttttttttttttttttgagacagagtttcccaggctggagtgcaatggcgcgatttcggctcaccacaacttccacttcccgggttcaagcaattctgcttcagcctcccgagtggctaggattacaggcatgcaccaccatgcctagctcattttgtatttttagtagagatggggtttctccatgttggtcaggctggtctcgaactcgcgacctcacatgatctgcccgcctcggcctcccaaagtgttgtgattacaggcgtgagccgctgcgcctggcccaggttttgattctttagaaaagaagttggttggtatccttagggaagaatgtaattgaaatgaccatggactttttaaattcttggtcctgaaccatctcctagggcactgtccagcttacaggtggctgctgtaggctcaagtgctgctgtcagtttcagtcagttttgagctaagtggtggagtcccacatggctcaagagtgcaacctatggccaggcgcagtggctcatgcctgtaatcccagcactttgggaggctgaggtgggcggatcacctgaggtcaagagttcgagaccagctcggccaacatggtgaaaccctgtctctactaaaaatataaaaattagctgggtgtggtggtgggtgcctataatcccagctactcgggagaccgaggcaggataattgcttgaacctgggaggcggaggttgcagtgagccgagattgcgccactgcactccagcctgggtgacagagcaagacttcatctcaaagaaaaaagagtgcaacctaagtgtaaagaagccttagaagggggctgtgggcaaggcaagcactgacactagcttgtttggttaagtccctttgattaggaccatataaagcaaattattaatggagtaccatgatcattttcactgtggatgaatctgtgaatgttaataaatgtttggtgtaagagaaatctcattgcaacacagatagtttcaacctccttgccaagtgcttggggcttggtgtctactctagaaatgttattatgttgaattgactatgaagaaatactaaatatcaactagccaggcgcagtggctcacgcctacagttccagcactttgggagcctgaggcggaaggatccctttgaggtcaggaggttgagaccagcctgggcaacatggtgaaaccccagctctacacaaaatacaaaaaattaaccaggggtgattactcgcgccttcagtcccagctactcaggaggctgaggttgggggatggcttgaaccccagaggcagaggttgcagtgggcagagattgtgccactgcgctccagcctgggagacacagtgagaccctgtctccaaaaaaaaaaaaaaagtgaactagccctagcactggtaggatcaggaaccatcatgtaagatagctagtcatatcacattctagaaatgtgcttcagtcctaccatttgaacaattctaggattcaaaaccacaagattaatggtctttatgatatattttttccatggggaaaaatgaaaatgtcagctaccagagttctaataatacttttatcatcaattcatagcaatcttactgtgttaccacttcaaggagtgcctggaaattagtatatgctcaattgctctaattaactgaaatgaatgccatgtacccaattattatgctagtagaatgtgtcagtttattgaaaatataaagctattctgtactctggaaaccttttcttggatgacagatatatagctctagaaattaaaaccccataggttaacattctgtacagtttttcatgttttttttttttttttttgaggcagtctcgctctgtcaccaggctggagtgcagtggctccatctccactcactgcaacttctgcctcctgggttcaaatgattctcctgcctctacctcccaagtagctgagattgcaggtgcccaccaccatgcccaggtaatttttgtatttttttttttagtagaaatgggggtctcaccatgttggccaggctggtctcaaactcctgaccttaagtgatctgcctgcctcagcatcccaaaatgctgggattacaggtgtaagccaccgtgcctggtcgatactttttttttttaaactggcaacatggcatccactagggcacaatggaaatgttcttagaagggcttgaatagtttcccagactttggaggaaacctgacttatatggaaaagcctgaaggtgagaggctgatgggaacattgtggtggcaaagcctatagggtgagctttgaaccaagagggtggatgccctgttggcatggtagccttgttttaatctgttgaaagaaccccactctgcagaagagtgtagcagaatgtggcagtatgggctgtaccactagagtaggccaggaagggccacataagaagtcagcaaaataatgcatttactaaggaaattggccaccataagaagtccctagtttgggctgggcacagtggctcacgcctgtaatcccagcactttgggaggctgaggcaggctgatcacttgaggccaggagttcaagaccagtctggccaacatagtgaaacaccatctctactaaaaatacaaaaattagccaagcacagtggtgcatgcctgtaatcccagctacttgggaggctgaggcaggttgatcacttgaggccaggagttcaagaccagtctggccaacatagtgaaataccatctctactaaaaatacaaaaattagccagacacagtggtacatgcctgtaatcccagctacttgggaggctgaggcaggagaattgcttgaacccgggaggcagaggttgcagtgagccgagatcgtgtcactgcactccagcctggatgacacagcaagactctgtctcaaaaaaaaaaaagaagtccctagtttgggggtgtgggggatggtgagtctcgaaagactgataaaactgccccagtaggaaaagaggcaatgtttgagatatatcaccagttcagtgagaacatattgttcccttccataagctcctctcccactcccaatcccaatcctatggggtataggagtatcagagagtggttaaaaaagaaggtaaaaaggccaggcacagtggttcacacctgtaatcccagcactttgggaggctgaggcaggcggatcactgaggtcaggagtttgagaccagcctggccaacatggcgaaactccatctctactaaaattacaaaaattagccgggtgtggtggcgcacacttgtaatcccagctacttggaaggctgaggcaggagaattgcttgaatctgggaggcgaaggttgcggtgacttgacatcgcaccactgtactccagcctcggagatggagcaaggctctggctaaaagagagagagagagagagagaaggcagaacaaggaaagaaacaacaaatccctcttgctttctcatctggggttaggtctgagctgctggagagaaaagctttacttggatgagaaactgaagttttgctattatgctacattggacatttgtagtcctgaaaatgattgttactacttgaatgtttttggagatgccaggcaatctgccctggatgttcagttggggtagggaaggaaaacacaacagagaaaatttgaagatagcaatgggggagatgaatttacttccttctgtaccttatcaaacccaactcatttaattagccagtttctccctataaacccccattaccatgtaaactgtatttcagttatatgcaacatgagataacctgattgacagtgattgtgtgtgactcattagttagaaatctaatgaagattctttgctagaaccaggtggttctctttggactaaacagaacactggtacatgggtctgcagcatcagtatcacctgggagctgctagaaatgcagactcccaggccctatcccagacttacgtcatcagtagcttaacaagatcccccaggtgatccatatgcacattagagtttgaaaagcattgatttgagaactaagtatgttttacattttctcctagacaggaaaatcctcactttgacctcagtattgtgggaccctgaaatggaaggagctcagaatcatgagatctgagccctacctgtgttatgctggttgaatcatttcttggattctccaacatttttgtagttgtttaatcagatgaattataaggtctcatctggctctgacattgtgtaattctaagaaattttggttgaagcgaaagaaaaaataaagcccggttaaaaaatttaataaacctggtaacaatttgatgaaagagccactacagcttcaccgtgttgctgtgcaactgtgatggagggtattgtccatgcatccctgctcatcacttcgtcgtttgttagcccaaatgaaaagtcttttcctgtttaataacaattatccctcctgtattgaggaagaagcatatttgataagaaaagaagattattgctaaaacaaaatgatatttagagtggcgggctgccagcagctaccaaatcatttgtattggaatgattagtaaattctttttttttttttttgagacagagtcttgctctgttgcccaggctagagtgcaatggtgccatcttggctcactgcaacctctacctcccgggttcaggcaattctcctacctcagcctcccaagtagctgtgattacaggcgaccaccaccatggccagctaatttttttgtatttttagtagagacagggttctgccatgttggccaggctggtctcgaacttctgacctcaggtgatccacccatcttggcctccgaaagtgctggaattataggcatgagccaccgtgcccagccaagtaaattctttatttggaaagcagcatatgttttttttgatgtgtaaggattttttttttttttttttttttttttttttttttttagaaaggagaattgctctgttgtaaaacaaagatcacacacagacatagaacaaactcaaatttgacctcggtaatgtaagtcatgtggtggtgtaggcaaagaagaatgctagagccagtacttaagaatatatttcaggtgcatcgctgattcactgtgtgatgttggcaatgtcttttacctcttctatttctcagttctgctaccataaaagtgattgaattggattattccatcctgcatattaattgctgttcctgatagaggctgcctggaactttgggttgagaagtacagcagggcctcagcaagctcagtgggaaaggatcaatgaattaggcatgtctgctgtgggcgaggcaatagggagtgaccaactaattccatttgtttgcaaatttctgggttaggagctttctgaggacattgactatcttaaatgttttcatcctgaaaatattttaaaatggttttattataggataaaaataaagagagagagactgatttctagatttattattgcttctttgtttttgttattgtttttgttttgagtcagggtctcactctcacccaggctggtgtgcagtggcgtgatcacagctcactgcagctcccacctccctggctcaaagaatcctcccacctcagcctcccgagtagctgaactacataggtgcgcaccaccatgtccggctgatttttgtattttttgtagagatggggtttcaccatgttgcccagactggtcttgaactcctgggctcaagcaagctgcctgtcttggcctccaaaagtgctggcattacaggcatgagccaccacacttctttggagtcttgcaacagcttgaagtatatgtgtgctttcctgttcttgatagcaacttgcaggacaagctctgaagagaaggaaatctgcttggatttaaaagatattcagtgtgagataccagataggctggaagtgatttatgaaacgagttctctgttttgttaaaacataagattgttgttccatttggggacctttatatgaaacagatgcctaatctataaatcagccaccctgcagtaagggagatgacattttaaaataaattattgtggatccaggaagtaaaagtgtggatgaacaaatttttattgtcttctgggcataggaaacatcttatcagtcatctgtttgggacgatcttccccccgatgcttattaagggaattggtgatgaggaaagagtcgaaagttctgtctagaaatttgttctctgacctaacaaggcactcctcaggtttgacaggaacagcggcagaattgtggacttttccagctttgtcaagaaagcgctgctgttgcgtttgggtttcagtttcaaatgtagtcccccagaggaaactggattagagtagtttgtagagttcagagacggaatacatttatagttgttgggttttttccttttctgtcgagctcttcagtgggtctactttctacttcccattataaaaatgaacattttggcggggcatggtggttcatgtctctaactgaagcagtttgggaggccgaggagggaggatcacttgatactaggagtttgagaccagccccggcaacatagcaagaccccttctctacaaaaaaataaacaatattagccaggtatggtggtgcaccatctgtagtcccagctactcaggaggccgaggtaggtggattgcttgagcccaggagtttgagaccagcctgggaaacatagggagatcctgtctctatgaaaaatataaaaagtagctggatgtggtggtacacacctgtggtcccagctactcaggaggctgaggtaggaggattgcttgggtttgggaatggaggctgcagtgagcagtgattgtgccactacacttcagcctgggtgacagagcaagactctgtcttttgtcaaaaaaaaaaaaaaaaaggaaagaaagaaagaaagaaagaaaaatttcattgttttcatgtcatttcttgactgtttgatagttttctgatagtcagctaatgatcattgtctctgcacctgaaagccgcaagttcattcatgtattcattggtttagtaaaaagtattcacttaactctgatggagaggaagacatatggctggccacccaggttatagtgatgtttatataaggcatgctccatcttcaaggtttacaacccagcaaggggccataaatacagtatatccaaaatgacaggtaattcaaatatgagttccaactgattttggaagtcttttttcattttagaagacattaatcattttctttagcttgatttaattttttgagttgataatttagtcacatggttcaaaaataaaagtggaatcaaaagtcttactctaattcctgacccaacctacctaatttactacccttcggcctcctgtatgtaaccactcttattaattttctgcagagccttctggtatttatttttgtgcagatataaatatattcttattttccctccttttacgtagaagttcgcatactatattactgttttgcatgctacctttttcacttaattgttttcctgtgacatttcacagggcatagggaacttcattctctttttcatagctgtgaatattgtatggaagtactgtggcttattcacccactcatctctagatgagtgtttgggtattcccagcctctggctcacacacaactctacaatcgatacaagggtgtatctgaaacttcatatagtgctggtttaggtttagctgtaaaacaaattcccaggagtgaaattgctgagtaaaaaaataaatgcatttgtaattttgatagggattgccaatcagctccccaaagcgttgcaccattttggactctcaccagcaatggatgagagtgcttaattctcctattgattataagatatgttgtaaaacttttggattggatttttgccaacttgatagggaaaaaaatgatatccctgcatagctttgatgtggatttttctaattaaaagtgaggttaggccaggtgtgttggctcacgcctgtaatcttagcactgaaaggctggggtgggtgcactgcttgagccaaggagtttgagaccaacctagacaacgtggtgaaaccctgtctctacaaaaaatagaaaaagtaaccagctgtggtggtatgtgcctgttgtcccagaaactcaggaggctaaggtgggaggatcacatgagcccagggaggttgaggctgcagtgagccatgatcgcaccactgcactccagcctggggaacagagtgagaccctgtctcaaaaacaaaacaaaaatgagattaaatgtctttttatatggttaagagacccttatattttttttttgtgacctgtcaatgtcttttggtcatattgctattgctttgttgattttttttcaaaatttctcagaggaaaatttagtcttcttcatgaacatttattctaaagatcttttttctttctttctttctttctttcttttttttttttttttttttttttttgtgagatgtatcttgctatgttgcctaggctgaactcacactcctgggctcaagcaatccttctccttcacctctctagtctaagctaaattctctgtatgtgtgtacttgtttaaccctcagcaagcctgggaactgagtattgccagactatttttaaaatgaggaaacagaggttcagaatagttaagtgacttcaggccatacagccaggcagaggcaaaactgatgtctggaatcaagttggtcttactgctaaattctgtcctcttaattgcccagctttactgtttttcttaggtggatgccagagttaactcattcaaactggtttttgtttcccaaacacacaagatgatggaggagtgtgttgctgagctcatgtttggtggtatgtgagactccagctgggataagaaacacaccatgtataatccacccagtgaataatccccagggagattgattgtacacttccccctaccccggaaagccttatgatagtgtgactaaagccaagaagaaacagaaatgacacatggctgaaattacacaggaaaaggatcacatcgaggcaagcgtcataagatgcacatggccactgtgaaccaagcatgtaaatcaaacatcaccaaaagtggttcccattagaggcccagaaaaaatttcaatgttgcagttatttctgcttctcctgccttaaaggaggtgtaatcaccgaatgagctcatcttgcccactgtgcagaaaaaaccaattcactgagacagtggtattataatagagaaagagtttaattaacttagagctagccaaatggaaggatgggaagtttattactcaaatttagtctgtcagaattcaaaggctggggttttcatggacactttggctagcgggggatagggaatgtgtgctgctgatttattggggatgaaattataggaatgtggaaaatgatcctcttgcacagaatcagcctctgggtggggaccacaggaccagctatcatgagccatgggtccaagtgaagtcagttggtcactagaatgcagaagtttgaaaaacatctcaaaagaccaaccttaggttctacaatagtgatgttatctatagaagcaattggggaagtaggacctccagcacagtaaccaattatagaggggcaagctacacttacatttttagcaaaattcaagccactcctataattctaatcttgaggcctttgttttgttttgttttgttttgttttgttttgttttgtttgaggcagagacttgctgtgtcacccaggctggaatgcagtaatgcgatcatagctcactgcaatctcaaactcctgggcacaagtgatcctcctgcctcagcctcctgagtagtcaggactacaggcacttactaccatgcccagctaatttttaaattttttgtagggatggagtcttgctttgttgtccaggctggtcttgaactcctgagctcaagcaatcttcctgccttggcctctcaaaatgctgggattacaggcatgagccactttgcccagcctgtggcttttcattagtcttacaaaggcagtttcagtccctgaacaaggagagtgtcagttttagggaaggactattatcatcctttctttaatgttaaaccataaagtaaattcctcccatggttagcttggcttgtgcctgggaataagcgaggacagccagcctgtgaggctagaagcaagaaggagtcagccatgctagactttctcactgtcataatcttcacaaaggcggtttcataggcttctgggaaacctggattataggaggtatctgaagtccatcgccaacttctttctcaaacagcttggccagaacctggagatttgggagttcttgggaaagatgctttctcttcccaactttctatgctcatgctgtggataaaaaattgagcgggccccaaaagagcaaaatagatgaaatcgtggttcatttatggcatttgacaaatctgcaagattcgatgcaagtgcactactaaatgattaaaaccccaggttctgccctccgggaatgtgtgagagtattatattactcctgaataatgtaaccactgcagttttctgccagttcaaaaatatagccaagatgccctttttcactgtatttaccaatgacattctacaagccatcttccctgtagcaagtttccctattttcttttgctttagtttattatgatttaataaaaattgaatcagtggatttaagcttaattaaagctactgtcatgtttttaagcaaggtagcaggtgtatatgaaaacgtatgctgacaagattcaggaagtgtctcctggtacggtctcagagatactgggaattaaatggatcactcacacataggaggggagtcagaatggatttggttttgctgagaatttaatttaagttttcattaggatatagaagttcagcatttcccctgaatagtatatgttcaaaagtggaaaaagtagaggaaatagattgttgttcccaatgcttcagcttgatgtgttaggagagcttgcaatagtataaccagggagatctttggattgtcagctatatcatcgatcaggggttggcaaacttttcctgtatcaggcctgatagtaaatatttaaggctttgaggttcataaggtctttgttgcagttattcatctctgccgttatagtgtgaaagagtcagagacaacacataaatgaatgggtatggctttgtgtcaatacaactttatttataaaaacagacttcaggcacatcttggcccaaaagccataccttgccatagaacaaagcttgagtgctttctttcctaggtaggaaatcctgcactgggtagtacccttagattataagacagtgctttcatttgtaatgtgtatgattgtctccagccacacaattttagaacaagtcaccagcgagaggaccatgtacgtggccttcaccatttcttcatttccatcgtccttcttgctctcacctccttttatgcatgtcatttatttgatacttcctttatctctgtcacgtgcctctatcttttcagttcatttctactttcctgttaactctagagatggtatgaggaaggagttaggcatttggacccaaagctcactcatacctgggttcaaatcttggctgagtcacttatttaagaagttttttgtttgctcggattatgtttgtctgtctttcaaatgaggctcaaggtaggtaatttacaaagttactgtgatgtttaaaagaatatgaatgatgctttacaaattagtaatcaataaatgctaattaaagatactcacaaaatatacctaaattgttactactgtactttgtaatttctgacattctacttttatgaatcaaactctcaatttcttccagactttcatatttgtttattttgggagctgaaatgtcctcagaagaaagtaactgttttggttattattaagctagatgatgagggccaaaaccacaaaataacagtggcttagacaagagaagctggtgtagaaagaatggtgcccagtatcaaagccccttccatctgtgtctcctacttccattccaatgtgtctgctcgagctcctcgagcagttaagcaatcagagaggtcagggcagaaagggcagaaaacgagaggcttccatagacaaccagtggctccctcaggcactctccatcacgtaaacctgttttaccttctccactgactgcaatcatcttgtgtttttgtttacttgtttattgtctatttcttctcagtagaacataagcatcaggagctcagggactttgtcttatttgccactgttttccccacacctgataccatggctggtactttgtagacacacactcaacaactttccttctttccttcctcctctcccctccccttcccttcccttctctctgcttttattttagattcagggggtacaagtgccggtttgttacttgggtatatgatgtgatcctgaagtttgggttatgaatgatcctgtcactcaggtactaagcatagtatccaacagtctttcagcccttgcccctactccctccctccaccagccagtagtccccagtgtctattgttgccatctttatgtccataagtacccaatgtttagctcccacttacaggtgagaacattcagtatttggttttctgtttctgtgacattcaccgtctttagaatgaattccagagtaaaattattttgctttgacataataaaaggatatccttcaaagtgttttgtgcatagtaggtcctcagtgaagccgcctggaatgagcaattgaacaatgaatataataccagtcagcttagattagtgtcagataataataatagttaacaatgattacgtgccaaggaatatgcgaagtgttttacaggctttatctcatttattcctccagcaacccaaggacagtaaggagtaatagttatctcaccttaatgataagaaaattagatttcagggaagttaaatacactgcccaaggtataccattggaaaaaaaacaaaacaacaacaacaactcaacagacccaggacttgcactaggtatatcagattttaaggctggtggtcttaaacaataggcagcccacagaggacacagctaaactatgtgaatccatgaatccattgaggtgatttccggattcctggactaattgcaataaaagatgtttgaggtgcaatagaccagtttctaatatgtgtggcaaagtaatacaaagaagcactttgctaagaaattagtcattgtccattgacttggcagtgagtctatctgaacttgttctattatcttgttatgattagtgatagatcaacttaaattaaagggaaagttaatgaagtgaaacccaaaagttagccaaaggagaaaaaaaagtctagttgataaaagctggacttgaggtttttcttccaatatttgaagtctcattttcttttttaaataaaaaagaactaagtgtccaaaattttctttaattaggcatattttccctcaacttttattttaatttctcgggtacatgggcaggatgtgcgggtttgttacataggtaaacatgtgccatggtgatttgctgcacagatcaacccatcacctaggtattaagcccagcatccattagctattcttcctcatgctctccatccccacagccccctgacaggcctcagtgtgtgttgtttcccctcatgtgtccatgtgttctcattgttcagctcccacttacaagtgagaacatggggtatttcagtttcttttcctgcgttagtttgctgaggatcatggcatccagctctatccatgtccttgcaaaggacattatcttgttcctttttgtggttttttaaaaatagcatgcagctaaatgtgaccagagttcaggttttaacaattacagctatagaaaataactcagaattcattttttaaaaaataaaagtcaaaatcttcctgtttgaggcaatgtgggatgcaggaaacgttctggacttggaagttagacacagccagcttggcaatgcttgctttgccagtttctggctggggggccaatgtcttctcatttccctgagacttggtttccttatcttttaaaaaaaattagaatggtactataatttcctctgctattaggtcatgaaggatcaatgccaccacacccggctaattttgtatgtttagtggaaacaaggtttcaccatgttggccaggctggtctcgaactcctgacctcaagtgatctgcccaccttgacctcccaacatgctgggattacagacatgagccgctgcatccagttttctggacttttatggagcctagctcaatgtaaatcactgagcttactcctcaacttttttttttttttgagatgaagtctcactttgtcacccaggctggagtacagtggcgctatctcggctcactgcaacctctgtctcccgggttcaaagattctcctgcctcaacctactgagtagctggaattacaggcacccaccacaatgcccagctaatttttctatttttggttgagacagggtttcaccatgttggccaggctggtctccaactcctgaccttaggtgatccaccagccttggccccccaaagtgctgggattacaggcatcagccattgcgcccagccttactctttaactttacttggctgaagtaaatctgtgtaggtttttatcaacacttagaaaaattcaggaataacgtacctatagcaaagtgcataaatcttaagtgttcagtgctctgcataatttaaacatgtacacatgcagcatgcagtggctcatgcctataatcccaacactgggaggctgaggagggaggattgcttgagctcaagagtttgagaccacctgggcaacatagagagactttgtttctccaaaaaaaaaaaaaaaaaaaaaattagttgggcatagtggcatgtacctgtattcccagctacttaggaggctgaggtgggaggatcgcttgagcctgggaggtgtaggctgcagggatccataatggcaccattgcactctagcctggacgacagaatgagactctgtctcaaaaaataaaaataaaaatatcagtaagtaaataaagtatacaaccacatacctccaacccagatcaagatggagaatatttccagcaccgaggttttctcatactcttcctaattggtacttcctccaaggataactaatatttaaattttttttaacttttcattttgaaataatttcagccttacaaaaaaattgccaagtagtataaagtatccctgcctactcttcactcacctttcccaagtcatgaaatacttataaaaaccaggaaattaacgtcaatagaattctatagaccttgtagacctttcaccaatttttccacgaatatctttttttctggtccaggatcaatgccaggttcacacattgtatcctgttgttatgtttctttagcctaatgcaatctggaacagttcctctgtccttcctgtcttttatgacagtttaagaggctggtcagttattttatataatatccctcaatttaagtttgtgtgatgtttcctcatgattaaattcaggctatgcatttttggcaatgctgtgacagagatcttacgcccttcttagtgcttactatctggaggtacatgatgatgtctcactggtagtgatgttagccttgatcacatgataaaggcgatatcttccagatctctcaactttaaagttattatttctgcctttctaattaataaatatcttgttgggagatattttgaaatgatgcaaatatcttgttactcatcatacatttacctactaattttagcacccattattgctgtttgccaaatagtggttctctactttgatcattccttctacatttatgaattggaattctattgtaagaaagaggtatcccttctccccatttaatttttttttttttttttaaagactgagtcttgcttattgcccaggctggagttcagtgacgtgatctcagctcactgcaacctttgcctcccaggttcaaataattctcctgcctcagcctcccgagtagctgggattacaggcacccgccaccacacctgggtaatttttgtgtttttagtggagacggggtttcaccatgttggccaggctggtgttgaacctcaagtgatccatccgcctcagcctcccaaggtgctgggattacaggcgtgagcacccggcctacttttttttttccgaggcagtcttgctctttcacccaggctggagtgcagtggcgcgatctcagctcactgcaaccttcaccttccaggttcaagtgattctcgtccctcaccctcctgagtagctgggactacaggtatgcgccaccacgcctggttaattttttgtatttttaggatggggttttgccatgttggtcaggctggtcttcagctcctggcctcaaatgatctgctcgccttgacatcctagagtgctgggattacagacgtgacccaccgcgcccagcccccatttacttctttattcaattatatacttaatatttaaatgtgttacttaaattttatatactaaatataatttaataagtacatttaaaattgttttataattatatatgttatatatttatttaccaactattcatttagtgtcagcctgtactcacggttattttcttttattttttgtgttataacccatcactgccagtgtttgttgctcacattgtcccagctttggtcattgggattgccttcatgcttgctcctgtgtctactttctgcaaccataagatgttccagactcgtcttgtgcttttcctgccccagtgctggaatcaatcatttctttaagaagctcttattctttttaataataaaaaactagagatggggtctcgctacattgaccaggctggtctcaaacttatggcctcaagtgattctcccatctcggcctcccaaagtactgggattgcaggcatgagccactgtgagcagccaagacacccttattattttcactggggaatggcatagagacagacctgggctcattgcttgtgaggtgtcatttcttttgttgcttctaggtcctttgagcagaaagcacttggacacatacatgtgtatactaacatacacacgcatctacttctatttctacatctatctgtatagctgtgtagctatgtctataaaactgtggttctggctgggcgtggtggcttatgactgtaatcctagcactttgggaggatgaggcgggaggatcacttgagctcagaagttcaagatcatcatgggcagcatggtgagatcttgtctctacaaaaaatttaataattagctgggtgtggtggcacatgaacacacatagcatagcttcagagttggtaatccatacccctctgaagataaaatttaactagaatacaatatttgtgtacatttttttagtcttgtaatacgtagcaaaaaaaaaatattgtgttctaaatttacttaggttagtttgctcaacccctacacccagtgattattgttagtggtgtctcagttttatttgttaatgtttgtattctgtttgttttctccctacattctggttgatttcaattatgtatttatttccttaggatgtaaaacattaccatgattctggaatctagaactatactcagaagtatgtcattctcctttcatatgttccaccccactcccatttccccattctttccaccccatttccacttttctgttgttaatcagtctcattagtttccatggtgtccatcccttgtatatttcctttcatctccttctttcttacacagaggtagcctactacagatactctgttttttcacttgaaacatgctattggaaattactttataccagttcattgagagcttcctcattctctttttacagcaacacaatactccattgtgtgagtgtgcttcagtttattcatccagtatcccatctgtgggcatgtaggtggtttccaatattttacaatgacaaacaatgctgtaattatttgtgtgtatttttatattgttggaaatgtgtctccactatgaattgctagaaagggaattgctggctcaacatgttagtgggtagttttgtcaggtagttccaaattcccctctgtagggattgtactatcatgtatttccatcagcagtgtatgacagtgtctatttccctatgatcttgctatcagaatgatttgtcatactttttttttgagacagggtctcgctctgtcacccctgctggagtgcagtggcttgatcatgactcactgcagcctcgaccacccaggcccaagtgatcctcccacctcagcctcctgagtagctgggaccacaggtgaacgccaccatgcctggctgatttttatattgtttaaagagattggggtttcaccatgttgcctaggctggtctcaaactcttgggctcaagtgatctgctcaccctggcctcctaaagtgctgggattacaggagtgagccaccacgcccagggtgtcataccttttgatttttacaaatctagcaggtggggaatggtatttcaatatagttttaatttacatttatctaattggggggcagtttgcacatcttgtcaactgtacatctgtacatatgtatttttaaggaccatctgtacatatgtattttttgtgctgaattgtctgtccatgtgtctttccccttcttttattagttttaatctaatttcaaaatgttctctctctctttttggaaacagagtcttgctctgttgcccaggctggagtgcagtggcgtgatctctgctcactacaacctccgccttctgggttcaagtgattctcgtgcctcaacctcctgagtagctgggagtacaggcgtgcaccaccatgcccgactaatattttttattattttattttcgtagacacggtgtttcaccctgttgcccaggctgttcttgaactcctgagctcaggcaatctgtccacctcagcctcccaaagtgctaggattacaggtgtgagccaccacacccagctagagatattagtcttttttttatatatacatattgcaaatattttctttaggtttgtccagttgtctttttgtcatacataattgttaatgtgtgtgacaaaatacacattatgcggtcaaatttatccctcttttactgcctcaggatttttgagtcattataaagtctttccctacattaaggttaatgaggaattcacccatgttttcttttagtatatgtatagttttacttattttttcctttttcatttagcttcctggtccatttggagtttattcttgtgcgtgatgggaaatatgcatttaattttatcttttacaagtggctattcatttttctcagccctatttagtaaaaatctgtctttgccccagtgatttgaagtgccatctttatcatacgctaaaagtgttcatttcaatttgaatctatatttgggcattttattccacaagtctatttgtcttttttttttttttttttttttttttttttgcacccgttgcactgctttgattataaaatctattggtctggtgaggcaagaccacctttgaaatttttctttttcagtgtaggtaacaactcttcctgacttccatcaccttagattgaatttgcctgtttttgaacttcatgtaatagaatcatatggtatctgttattttatgtctgacttctttcatttgatctggtatctgtgagatacattcatgctgttggaagtagccgcaccttgttcgttttcagtattgtgtcctatttctttgtatgtctctaccacaactgatcgatccgtattttgtttatacatatgtaaattgtttccagttgggtgctgttgtgaagaaagctgttatgaactttttttttttttttttttttttggcacaccaatgcacacatgtctctcagaattcctaggagtgaaattgcttgggcataggataaatgaatatttagctttggtagataataccaaagagtttttcaaagtgtttgtaccaatttgctagcacatagtattgtcagtctttttttttttttaattaaaaagtaaactttaatgtcaaaaatgcaaacttggggaaggcagaaagatcacacacaaggctgtcacttcacacttggaaggttgcacagcggcccagacagtggaggggccgggagtattgtcagtctttgaagctgccttaaaagaaaagaagaaagaaaaccttgtatgacataattcttcttcctcttgaaactcaagagtcatttccaaaacaggaaatggctagaaacaaaacaaaacaaacccagcaacctccattttttaaaacacacctaacaagttacttgtggcagtcatgggttttatagaaaaatacagaaaagctgttttgagcctagatcaaatgtagcaggcagtttgttttttaccccaaagctgttttcaggctgggcacagtggctcacaactgtaatcccagcactttgggaggtcaaggtgggtggattacctgaggtcaggagttcgagactagcctgaccatcatggtgaaaccctgtctctactaaaaatagaaaaattagccaggcgtggtggcacatgcctgtaattcccgctacttgggaggccgaggcaggagaatcgcttgaacccgggcggcagaggttgctgtgagccaagattgcgccactgcactccagcctgggcaacgagagcgaagctctgtcaaaaaaaaagccattttctccctttctgtctttctagcaggacctcagttttgttcagcatgttcagcagggaaggtgatcttatccctagcttaggggcgaatcttgtttcatctaagctaatcagggctttctctttttttttgagacagtctttctctgtcgccccaggctggactgcagtggtgcgatcttggctcactgcagcctccacctcctgggctcaagtaattctcctgcctcagcctcctgaggagctgggattacaggcacgagccaccatacctggctaatttttgtattttttagtagagatgagatttcaccatattggccaggctagtctcaaactcctgacctcaagtgatcctccagccgcaacctcccaaagtgctgggattacaggtgtgagccatggtgcccagccctaatcagggctttcttattcctctcaccagcaattagcttagggatgagcatgtgacccaggctggctaataaaatatgagatatgaggaacactggcatagctctgtagtggagggctcctgggaatggttttttagtgctaaagagactccagcagagacggcccctttttgcctccggatgtggtatgtctggatgtgatgcctggaactgcaacagccatctggctgccagccgaaaatgaagcaaatccatgaaagaatcagaacaaatggaggtggagtcttaaatacaggatctggaacctgccatattccaagtttatgtgaagtaacaaattgaccaattgtttaagaccatttgagctggtattttctattactgaccattccacctaatacccctggtactgggctttgttagaataacatagaataacaaaggggagacaaggctcttacttatcccctgcaaatatgttttagcaacctcctctttgttctaaaccagtggttttcaatctttagcatgcctcaaaatcacctggagagttgattaaaacagcttgctggacttgactgtcagagtttctgattaagtgggtttgagatgaggtcaagaatttgcatttttatcaagttcctaagtgactctgaggctgctggtcaagggaccacacttcaagaatgattattctagaatacagacaccatcttactgcatttagtaacattttttaaaaaaagtcaaataatatatatcatgggcttctttttcagcttgagaaatataatttttttttttttttttgagacagagtcttgccgtgtcatctaggctggagtgcagtggtgcgatctcggctcactgcaatctctgcctcctgggttcaagcgattctcctgcctcagcctcctgagtagctggtactcaagcatgcactaccatacccagctaatttttgtatttttagtagagatggggtttcaccatcctggccaggctggtcttgaactcctgacctcaggtgatctgcccacctcagcctcccaaagtgctaggattacaggcatgagccactgcgcctggtcaaaaaatagaaatctctatcatcattttgaatgacaacctagtattgcatcacgtggatatactagaatttatataactgtttctaacagcatattctgttaatttgtggggtttttttgtattattatattaacatgaacaactctatcgtaagtatcattttatagtaatcctaactgtttaataatttccttaaggcaaattcttaaaagaattgctggatcagagggaaatgtttggggctttttttttttctcatatcgtcttcgtaatccacctaatttctacttccagatatattgcccttagatttagatattttgccaggggacttctggttgatcctgcctcagctggccaaggccttggccatttgctctgtaggggtctttctttaatgttgcaagagttgaacactaaagatagcactgccaggcctgggctagctcattcctaagagttaatttaaaaatttttaccaggaagagaataaaagcctgggaagttcttaagacttctgtctttctctacatcatgagaatttgagcatactttctgtctttgtcatatttctatttgagaatagaggcaaccaactgcctaatactccaaagagaaggaaagaagttgcattcagatgtcatctgccgatcatctcagtcatgaaagaaagtcatccagcagagggaaaagctgggtccaagttatgtctttatgctcgaccatggaagaatttattttcagatgtacttgccctcctaaatcagagcagcacttctagtttagctgggacttctagtagaattcaaaaaagtgtcctcagttgagtgtgttggttcatgcctataatcccagcactttgagaaaccaaggagagtggatcacttgagcccaggagtttgagacccgcctgggcaacatagtgagaccctgtccctaccaaaaagtaaattaaaacaaaaattagccgggtgcagtggtacacacctgtagtcccagctacttgggaggctgaggtgggaggatcacttgagcccacggcattgaggctgcagtgagccatgattgtgccactgcactccagcctgggcaacagaggaagaccccatctcaacaaaaaccaaaaaacaaaaaacaaaaagggtcctcaccagaagagagctggcaaacaaaatacaaattaagactggctttggcttgagttctttagaaagtagagcctgaggcaaagcttaaggtgcctaatgcaattttattattattattattattattattattattattgttcattttgttttgtgtttctgtagagatggagtcttcttgctgtgttgcccaggctagtcttgaactcctaggttcaagcaattctcctgcctcagcctcccaaactgctgggattacaggcatgaactactgcacccagtccaattttattttaaatataaaagtttgtgtctctttcacttaaaaacacagtattgactggttcattatgccactgatatatagcatccaagattgttccaactcttgccaattctcagccattgtgtggggtggcgatagatgaagagagagaaagagaaaggaaagggaggaggaggatgatagagagagaaggggtgttgagggagaggtataaacttgcttgtttttaggggcattttctggaatttgcatatatcacatctgctcacatcccacaagcaagaacttggtcaaatagccgttcagctcaaagagtttgttctgtatctgtgcagtcatgaggaaggcactacaattttgatctgggagtttcaaacccagcgagatggtgagggcaaaagacaagccaggcaaggaaatatgtgaagcaaggtgatgctttctatctcaagccagtcatgaggaggcacgtgggccgctcagcaggcttgtttggtttgcacacagttctttctgcaagggttgcagaggggaactatgactggaaatagtccctgggagaggaaaaacaggggagatccatctgctcctcaccctcctatcttgcatttcccgttggtttgttcccactggccgaggcttacgcccataaggagcaacacctcctctcttcctgttgtgtaacccatccccttggcaacagttcaggaagcagatcccacaccctgggaatggaacggtgacccacatgaatggggggcatggaccaggagaggggaagcacctgagaaggtttactgggtctgtgttccaatatattacttaatggcattttgagtggaaaataaaaagggctttgatgaaaacttttctaactgatgtccatcttttggagtcctgagttggtttctcagtaccttgcaaaaagaactaattgatcagaggctgataggtagaagggcgtctcccttgatcttcggccaagaattcttctagcctaggaatgtttttgttagacattgcagaaacctaaatgaggtttaggacaacccatggatgtgcattaggatgctgtagaaagtgttctctccctcccttcctttcttcattttttcttcctcttccctttcctctcccgttccttctttccttccttccaaacgggaaattttactgcgattacctttgttttgttaagaagcttgaactctttcatggcatttttcctagaaaacaagcaatgtgcaaactggcctttccatatggcatggaatatggactactagccaaccaagttagaatatactttaggctgcctctgtctgggcctgacatatttctttactgtgaacctgtgaacttggaaatgcaactgaattaggttgggcatggtgctcacacctgtaatcccagcacattgggaggcctaggtgagaggatatcttgaggccaggagttcaaaatcagcctggaagacaaaatgagactacgtctctacaaaaaaatttaaaagccgggcatggtgggatgtgcctgtagcccccagctatttgagaggctgagatgggaggagtgtttgaatccaggaaggtagaaggtagaggctgcagtgagttgtgattatgccactgggcaacagataagcaaaagacccttcactgaaaatgagaagcggcttcagtggaagcatctggctgctctccagtgacctttaaaaacagaaaattgatcatattggcacaactgctgtttgagagtctgaatgcgtagtgactaagttcacatcctctagattcaaaagcataaaattctaaatcttcctctaagtatctcagtgaacttgggaatgttactgaacacttagactcagctttatttgcagtttaatgggcattgtaacaccacgcagtattataatagtatctgttacacaaaattagccaggcctggtggcgtgtgcctgtaatcccagctacttgggaggctgaggcaggagaatcacttgaactcgggaggcaggcagaggttgtagtgagctgagatcatgccattgcactccagcctgggcaacaaaagtgaaactgcatctcaaaaataataataataataatatctgttatactactatccaccttacatgggtattgtaagggctaaatgagataaaacatgtcaggctcctggcacataatacatgctcagtgaatggcagaagctattgttttcatagtagtcgtcatcatcatcatcatcatcatcatcttattgtatggcttactattgttccattgaggactgcagaataaaatattgacactggtcaaggtatttaacatttgagggtctttagtgacctttcatctcagtaaagggacactagcaattatcgtcaggtatgcaggcacgtgaggatggtgcttgcacagtatcaacccctcagtcattggtttgtttcaggttataccaccatcatgttgaactttttaaaaaagtatcttagccctctgatcaaagggcaaaggtgcttacctccagtttctttcccagtgtcttgttatgaaaacttgtgctgggcacggtggctcacgcctgtaatcccagcactttggaaggccaaggcgggcagatcacctgaagtcaggagttcgagaccagcctggccaacacgatgaaaccccgtctctactgaaaatacaaaaattagccaggtgtggtgccaggtgcctgtaatcccagcaacttgggaggctgaggcaggagaatcgcttgaacacaggaggcaggggttgcagtgagctgagattgcaccactgcactccagtctgggcaacagagcgagtctccatcccaaaaaaaagaaaacttgtaaatgatgttcggggtttgttggaatccctgtggaggttccaggtctcacctgcacactaaaatattctccttgtctgtggaagctttctggtgctctagcttaaaaggagcacatctaactttctaattccagtctttatcttaatttaaaaaaaaaaaaacacccaaacgccttatgtgaagtttattagggcaataatgctgtggtattgctaattgctggcagacacatcaatccatttgtttgccttaccctagagggattttaaagttatcaattctatttgttggtttctaatagaaagccagggcttatcccataaattctgaagctgtggaactaggaacattaggactcttcctgcctattttggagcatgtatcattgcactggctccctaaccccaggagagatatattacagatggagtgtatgccccataaaataaagtgtcatatcttcttgacgcagcaattcttagctgcaaagacaatgattcatctagtcagtgccagcttctaaatgagaaaaaagaaagaaagatgattaggaagattcatcctttgactctctgtctccatttctcttccaagcctacttttagaaaaccactaggttccagaatctgcatcatggggtctgaactttctagttcttgatcctcaaaggagataaaagtgaaagcagagtgcatcttctgaatagcatcctggggaaggtgggctttgtgaagtaaccagttgtgtacaaatgaacaagctggctcccactctcctctctcacctctcctctggcctcagttcctccctaccttccaccagtccaaccacagtggtctccttaaaatgcctcagatacgcaagttcttcatgatgacctggagctctttccccagtctcatggctgagactttctcagcacaaatgaccactttctcggagaagcttccccaataacccggctgagaggagctcccaccctatcctgacagtactctttcaacactttgccctgttgtatcttttccttaatgtactagctagagtcatggctttatttacttgccccagtttgtgctttttagtgtttttctcatctagaaaataaataccatgagagcaaaaacctcatttgactttttctctactctactcccaggtactggaaggaattctagaatttttttcctctgtttttaatatatttttacatttttaaatattaacttaagccctttttctttctttcttttttctgagacagggtcccccctccatcgcccagcctggagggcagtggcacaatctcggctcactgcaacctccgcctcccaggctcaagcgatcctcccacctcagcctcccaaatagctgggactacaggcatgcaccaccatgctgggctattgctttgtatttttggtagagacagggttttctgatgttgcccaggctggtgttgaactcctgagctcaagcaatccacctgcctcggcttcccaaagtgctgagattacaggcgtgatgcttgtctgagattgtagaatttagtaagtacaaagagttcttgatatgggctcagatgatttgggtggcagttccagaactgtgtaaatgtggtccagtttcttgtcttcctgagtttcattccctcatccgtaaaatgggagtaataatacctacctcacagagtacttgtgaagatcactggaacaatgatcaagaaaaaaatatatacatatattttttgagacagggtcttcctctgtagcccaggttggagtgcaatggcttgatcacagcttgctggtctcaaactcttgggctcaagcaatccacttgcctcagcctcccaaagtgctaggattgcaggcgtgagccaccacgcctggccgataaaatattttttattctgttactggttttacacttgggagagatatgagggtttcctaaaggaccttgataaatgaaagaatgacaatgaaatatcatgatactgaaaggggagctctcacaatctgagacaggtggtaaaatttaagatgcttatcccaccatatagaaagtatgtaaattgataacgacaagaaattacatcaattgactgtacagattccagaatgttagagcaggaagatttgttaagatatagttgagtgatttttagacgtgggtctctggagtactggggttttgttggagtcccctgggatccaggatatagcgggaaatagccaggaaagaggaggagctgagctgatagaaatacatgccccatctcccctaattcaatcagattaactgcattttatgcttttttttttttttttacattgtttcagaagctagttatttattgctcagaacccttccctcactctttcttcctgaccctgatttttgtgtgcagggaaatgggctcaacttcaagctatggagtgtggtcaaggtcattcatgacaatcctcttcctcagtttctcagtctccctggaagctatggattggcatatgacccagttttagcccatgaaatgtgagaataagccactttagcagttgctgctaaagtttttaggaagcttttattttcttactaaaaagggacatatgtggctgatatggtcctttcctgtcttcctcctcccttccatgctaacatcatgtctgccactacaacagcaatcttgtgaccatgtggctgtaagcacaggaatgcctggaatctcagaaacattggctctgacctccgtgagtcactgaaccaattccggcaaccacctggctccagacttcttgccatgtgaggaagaagccactattgtctaaaccagtgcagagttttctgtccttgcgtctcaaaaagcattcctcacagatatacatatattgtgcttccagataagattttgtttaggattctgagtctaaaaataatttgaaatctgatctcataccatcttttcattgtagagagataaggtaacagtttcagttgtctgttgctgcattacaaactatctcaaaactccctggcttaaaacaatagctgttttgttacctcttagaattctgtgagctgactgggttcagctgggcagttcctctgttccttgggatgtctgcattgcctacagttaccatgaggctcaatgggcttgtctaatgccttgacaggaatagtcagaaggctgggctcggctgggacacaggtcctttctctctcctcatgcagtttcagagcttctctctgtctacatggcctctccatgttgacttcgtacatggcaccttcacgcccccaaaagcagaagccaccaggccttcctaaggcttaggcccagatccagctttgtgtaacatctgcggcatccctttggttaaaatgagtcaggttcaaggatagaggactatctgagggcataaatacaagaggtgtgttttatgggaggcaatctttgcaggttagctactacagaaactgagacttagactgtgaaaagtagttgtctaaactgatagagtcataagtatttaaattagaacatcattgaagggatgagagctccaaagcgggatagaatgggagggtggaggggacaggcaagagaaaggacttatcctcagcccagggtttttaaatctcaggagtgttgacatttggggccagataatgtctggatggctgtcctgtgaattgtagaatgtttagcagtattcctggcctctacctggatgccattagcatctcccgtccaatttttattttttattttatttttttgagtcagtgtctcgctttgtcatccaggcttgagtgcaatggcttgatcttagctcactgcaagctttatctcctgggttcaattgattctcctgcctcagcctcctgggtagctgggactacatgcaggcaccaccacactcagctaatttttgtatttttagtagagacagggttttgccatgttggccaggctggtctttaactcctgacctcaggtgatctgcccacctcccaaagtgctgagattacaggcgtgagccacaatacccggcctcccctccaattttgacaactgaaaaaaatctccagtcagttgccaaatgttccatggaggcaaaaccactccccggttgagaacatagccctagccttagtgatgtttagagtatatctataactacacagaagcccagctgtctcacatgtgggtccaggcagcatgtttatattcttaaattctcccagtgggaaatgaagaaggtaggatactcaatttcacactctggtccacatgttttatgtggactcttcactttggaaaaagcttttttagttttgctgtaagttccccaacttgactttttttttttttttccgtgagatggatctcgctctgtcgcccaggctggagtgcagtggtacgatctcggctgactgcaacctccacctcccaggttcaaggctgaagctcctgcctcagcctcctgagtacctgggattacaggtgtgcaccaccacgcctggctaatttttgtatttttagtagagacagggatttccccatgttggtcaggctgatctgaaactcctgaccttgtgatctgcctgccttggcctcccaaagtgctgggattacagacgtgagccagccaacccggcaatttcacttttaaggttgtgtcttcaaatgaagcctgaacgggtggtccttcattgccagtgcatcgcactaagcacttcccttcctctcttttaaccaggagtcatccacaaataagtaggtggattttaaagccgtgggactgggtgacatcaactagagaaatcagaagatgaagaaagaagaaaagctggtggcttaggccagggtctaccctgaggccttctaacttttaaaggtaagtgtgtatgtgtatacatacatacatatgtatacacacatatcccagaaactagaaaaatgtatatgtacgtataaaacttttttggttttctccctatatttatacaaacatatatatgtatatatacacaaatacatattaatatatacacgtgtgtatgttatatgtgtacatgtttatttttctcatatatatatatgtatattttttagacaaagtctcactctgtcaccgacgctggagtgcagtggcctgatcacagctcactgcagcctcaactgggctcaggtgatcctcctgcctcagcctcccgagtagctgggactatgggcgcatgccaccacacccagctaatttttgtattttttggtagagatggggtttcgccataatacccaggctgatctcaaattcctgaactcaagcaatccgcccacctcagcatcccaaagtgctggaattaacaggcatgagccactgtgcccagcctatttttcctatttaattgaagaccaatttatatacagagtaagaaggaagaaactaaaataattctggatcttatagggacaatgcaaaagaatcaatctggtcactgctgagtccaggcttgtcattgtcccctctagaatattagggggcaaatgtatgagctccaagaatctcacgtgccttgctcagtggctcatgcctgtaatcccagcactttgggaggccgaggcaagcggatcacgaggtcaggagatgaagaccatcctagctaacacggtgaaaccccatctctactaaaaatacaaaaaattagccaggcgtggtggcaggtgcctgtagtcccagctacttggacgctgaggcagaagaatggcgtgaacccgggaggcggaggttgcagtgagccgagatcacgccactgcactccagccttgggcgacagagtgagactccgtctaaaaaaaaaaagaaacgcgcatggcgtggagtaagtgctcaggatattgtgaaaggaaaataaaaactctgggaccctcattcactaagccaaaaggaaaaaattcagctgaaagctgagtcatgatgcaagcaactgcctttcattttgttcctaagcggatagcagcagattaaaggttaaatgtctccactctgtgttcaccttatcttgtggaaagtgacaatttattgagaacaagaaggacacatagtaagcttttcccttacctgctccttttctcttgcaacgtgtggattcaggaatgtgaccgtaccctccctgtttctcccacagcctgcttttccccttcaaatattgaagccttcaaagtcatctttggagaaaggtacagacttgtctaccaggtgtgtcctcaactttggcaaaataaacttctaaagtgattgagacttgtctcagatactttttggtttacaatatgtctgtcaaatgagtgagtaagtatctgtgctgcaaggcaaagagctttaacatggagagcctgatgacatgggtggtaggtgcagctctgtgtgctgtcactggagtggatgctgtcagtgccctgctcaaatcccctttacttagaggggcatccatcctccagctgctgtgagctgtggcttcatccaggggagagatgatgatgacttagaccagggtgtttattgttagcagaagtgatagaagcggttggattctggatacattgtgatgatggagccgacaggattttctggtggataggctacagaaagtgagaaaaagagagcatgcaaggatgaaattcaaggttttaggccagagcaactggataaatggagttgaaatttgctgcaatatggaagactgcatgaggaacaagttaggggtggggtggaaggacaggagtcaagttttggccaggcgaatttcaacatatgtattagacatccaagaggagaaattgagtaagtagtttaataagcgagtctggagttcaggtgaaaggtctgggccagatataatttgggagttaaggatatatggatgatgtttaaagccatgagactgaaagaaattaccaaaggattgagtgtatttgaaaagagcagaggaacacgggctgaccttgaaactttaaaggtaaaggttggggctggacgtggtggctcatgcttgtaatcccaacactttgggaggatgaggtgggaaagttgcttgagcccaggggtttgtggctgcactgagctattatcttaacactgccctccggcctggtcaacagagtgagaccctgtctcttacaaaaaaaatagataaacaaaaaggaatcagaggctagtgtggtggctcacgcctctaatctcagcactttgggaggctgaggcgggcggatcgcttgagctcaggagttcaagactagcgtgggcaacagggtgaaaccccatcgctacaaaaaaaaaaaaaaaaaaagccaggtgtggtggcatgtacctgtaatcccggctactcgggaggctgaggcaggaaaatcgcttgaacctaggaggcagaggttgcagtgagccaagattgggccactgccctccagcctgggcaacagggcaagattctgtctcaaaaaaaaaaaaaaattgataaaataaaagacccattggtaccaatgggtctctaagatttatttcagttatcttattttgcaattctcttggggttaataagtttctcagtcttttcccaaatctacaaaaattagtgtatttccttatagttacccatcattggaaacaaattgctgctgttccagttatgtattgatgcataacacacttcaccaaaacccggtgacttaaagcatcaaccattttcttttcttttctttttttttttttttttttttgagatggagttttgctctttcgcccaggctgcagtgaagtggcacaatctcagctcactccaacctccacctccagagttcaagtgatcctcttgcatcagcctttcaagtaactgggattacaggtgccctccgccatgcctggctaatttttgtatttttaatatttttggccaggctggtcttgaactcctgacctcaggtgatccacccacctaggcctcccaaagtgctaggattgtaggtgtgagccaccgtgcccggcccccgttttcttatatgtcatgatttcgcagatgcagagacggggctgggctgggctgggctgggtgattcttctaatctagttggagtatctggaagtctgttgatagttttcaactggttgataaattaatctactcatggagtaggaatgtaaactgaatcgtgcagccaagcatgtaagaacatatgaaaagtaattacactatagtgtgtaggaaaagaaggttgggtattcctggggagaatatttcagtcttcttcacctccttggctattacagaagtgaagggaaatgactggaagtttggtaaattgcagcctaaataacaagagacaattttctagtgtgcagagaaaacaatgccattgaatcctgggcattcctctagttcatcagtctcatctcatctaatgattgagccttgaccttctgagctgaggattcttgtgtcagaagccacagttttacacatttctgcaggaatactttccaagcttttccaaggaagaaatttttgtttcttctgctgtgtttctgcagcggtttccactcacaggaagtcctaattatctgaggaaaactaccactagataaaaacactttaaacgaagagcaaacttcagtacatagcataggtgagtgtttggggtgcatgcaggttcaatgggaatttttcttgaaagaaaacaaaaataaaattataaaaagaaagttattttacttattcaataaaatgtttctgattgcaactacatgcaagaggcaaagaatgaagtaagtgttgattgttttgttttgcagaaaagtttaaaaaaaatatttttcaatatagtgagaccttttctctacgaaaaaattaaaaactaactgagtgtgatagtgtgcccctgttgtcccagctgcttgggaggctgaggcaggagaatcactttaacttgggaagtggagccgagatcacgccactgcactccagtctgggccacagagtgagactctgtctcaataaaaaaaatatatattttttagagacacagtgttgctattttgcccaggatggtcttgaactcctggcctcgagtaatcttcctgcttcagccttctgagtatgttttacataaaatttcaatcagtaaaattttataagatgtgacaagtcatccctcactcaagtgtcactttttcatcccaataaagatcagttttatagttatatacactcatgtacacatagctatgtacatgtatgtgtatgtatgtgtgtatatatctatatatatacacatataaatatgtaaacacactctgggtcttcagtatttttaacttttttgatctatagtatacttagagaaaaatggccgggtgcaatggctcacacctgtaatactagcactttggaaggctgaggcaggagaactgcttggggcacggagtttgagatcagactggacaacatagcaagacccccatctctacaaaataaaaattagccaggtgtggtgtcacgtgcctgcagtcccagctactgagaaagctgagggttgaggattgcttgagcgcaggaatccgaggctacagtgagctatggttataccactgcactccagtgccagtgacagagtgagaccctgtctcaaaaaaaatgaaaataacttcagaaaaagtcataagtgcacaactcagtgaattgtaattttcataagccgttcacacccatgttgtcagcacctaactccagaaagagaacattatcagcctcttagatgctcctctcttattcaaaagcagtcattattcaactccacccccaccgcaagtagcaactctcctgacttctgacagcatagatgagttttgattgtttttgaacttcatagaaagggaattgtattttgttatctggtttctttttctccatattacatctgtcaggtttacatatgttgttgctagtacttttttattcattctcattgctgcgtatttcatagtacgcatataccaacatttctctattccgccattgatggatatttgggaggtttccagtctgaggcttttatgaatagggttgtgaatggggttcaggacatgctacgtccaaaatatggcaccttggcatttgagaaaaccacagaagcaagaaggtctctctgatctgtctcacccttctcccctaatgtagtccatgaaaactagctgaccttcccctgagagtaggtgattagactctccttccagagaggtcctccctatacctggaggaaaggaatgaagacacagagatgccaagaagaatctgaagaaatagaccttgtaaattccccccagcttattcccattagatcatacccttttgtcctccaattatactttgacatgattcttcataaaagtacacacttgtatctgtttcttcaggtcttcttttgtgaaggctcccatgtcacataaaacttacatgaaataaatctgtatgcttttctcttgttaggtcaccttttgttacaggggcctcagccatgaaccttgtgatgggtgaggaaaagatcttactttttctcccctactgctgctaaaaacatagtatgtgagttttagcacacatgagtatccatttctgttgggtcatgatgtagtttttcttgcttatgaatctgttaacttagtcagatacatccaaaagtgttgcttcaatgacattttgcccatggttggaaccatacatgttcagtttcatggacatttatatactttatgaaagaatacacagtgattcagcactaaaaagaaaagttattatatccacggttttcacagttttcgtggctacagaagtaaagtagcagggtgcaaatgatgttattgaaacaaatatttgtcaaaggaggaatgacatcaattcctctaagtgttttgtggaaggaatctaagaagacagacaacctcaaggagatgaagctgccagttatactgagttcatgctgtttctcagatatatgcaaaagcatttcccatcacacatcatgcaactgaaggcaggagaaatggccaaattccttggaacagatgaaagatacttcagccgggtgcagtggctcatgcctgtaaagccagcattttgggaggccaagatgggcagatcatgaggtcaggagtttgagaccagcctggccaacatggtgaaaccccatttctactaaacatataaaaattagctgggcgttgttgtgcatacctgtaatcccagatattggggaggttgaggcagtagaatggcttgaacccaggaggcaaaggttgcagtgaactgagatcgtggcacggcactccagccttggtgacagagcaagactccgtctcaaaaaaaagatacttcaaagcagggaagagctgatgtgtctcattcatgtgtaatgcaggactgtcattaagaccttgcgtcatatttaagtggcctcatttttattcttccttggaggtagataaataacaaggcatttagtagctatgatgtcttataattgatgaagtatgataatcagaatgatcatattaaagctgtaatttattggtccaagcattgtgctcagcaatttacaaacattctctcgtttaatttaattcttcacagcagtcctatatggtaggtaatatattttagccttagagacattaggcaccttgggcaaagatacattggtagtaagtgatgaagccaggactcagaccctagtgtgtgactttgtgaatgctgactctgctcagcacctggaggtctgaggttttccagctgctctactggaggatgaattcaactgaggtgaccagggacgggaagatcatgctggcattgtgtctaggcagtgttcttcactccagctttgacagtcataaagctaccactctgaccctagttccgatcatttattacctgcactagttgtaatagtttccttattagaagtttccctgcttccaggccgggtgtggtggctcttgcctctaatcctagcactttgtggggctgaggcaggaggatcacttgagctcaggagttcaagatcagcctgggcaacatagtgagaccctatctctatttaaaaaaaaaaaagtttccctgcttccgacattgtctcctatcacccattctgagcacagcagctagagtgagcatttattgattgattgattgactgattgattgattgattgagacagggttgcactttgtcacccaggatgaagtgtcacgacaccatctcggctcactgcagccttgacctcccaggttcaagcgatcttcctgcctcagtcccccaagtagctgggacaacaggtgtgtgccactacactgggctaatttctgtgtttttagtagagacagggttttgtcatatttcccagcctggcctcaaactcctaggctgaagcaatccacccaccttggcctcccaaagtgctagaattccaggtgtgagccatggcgcctggcgtgaacatttaaaacgtaagtcaaggccataccccaaaccctccaaaggcttcctatcttggcataaaagctggagtgtgtggggtcctacaagaccttgtgccatgactctatgtcactctctccattccctccctcaggtacagcaatcccggcctccttacatatccaaactcagggtctttctcactttgtgtcctccaccaggaacagagttggagacaaggatttgaatataaattgtttttttggaaagtgaaggaaattgggaaaggagatggaaaggaaagggcgtgcccctcagccaactacccctgtgggcaactgatctcaattccactggcaaggtttgggagccggtgtagagcttgcacttcgggggtgaacaatcttagccctcctgaggggactgtctcaggcctggggtaaggcagggtccagtgcccagagaaggccttcaggcataaggggtgatgatgctggtcatttgacatcaggctggcactaaaatgggaaaacttgaggcatacggtcaagaccttgaaaatgtccacgacaggcccacagatttgctctactgtctgcctagaatattcttccctcgcatagtcccatattgctcccttagaactatattcaaatgactcttcagggaggacttttgtgattctcttcttcaaatcgtcccccaactcctagaacacacatatatcttgtttatggtctttcttctaccactaaataaaggcaccacgtgggcaggcattttggtctgttacatctgctgctttatccgcattgcttggtatggtgtgtgctgcataataggagttcgataaatatcgaatgaatgaatgagtgaaaggtcatttagaaactcttattttctgcgtctattgtcaattgacttggaatccttaggaatgaggaatatggttaattggcatcttcgaactccaatatatatctattattttatattagggcctgatggtgaataaccttcaatctcacccccctccacaaatgttgaacatctaccatgtgccagacactgttcaaagtactaggaatactgcgatatatcaactgggaatgacttttgtcagggaatgacagaaacaccgacagcaatggcttataccaaataagggttttatttttctcctgtaattagaagtctagacacagacagtccagtgcctgcgcagtggctccaaggggccactggggaccatgcctgcctctaccttctctatgtcgtcccagcttgctgctctccctccagcagtgtctgtattccattaaggaaggggaaatggaaggggagaaggtatgttccagaggattcctccctccaggatgctttcccgaaaagctctacacaacaatttctggtcgtatctctttgcacatcttgtggctacccctagcagcaggggagctaagaaatgtagcatttgtttgcttttgttttctttgatgggctccttgttttctgtaaacaaacttgggaagtagggtacaattaaatgcatcttgggtaggtgactagcaataccgtccataagactaataaccatgttctcttgaagctgtcactatagtgcaggcaaacagaaaacaaggaagcaaacacacaccaacttgtaaaaaattccaaatgtaatagccacaagtgctgtgcagggtccttaataataagggggagttagaagttgactcaggttctatattatacctgggagtcaaaggagcagctctccaaggaagtgacatcggagctgaattctgaatgatgaggcagaggcgactttgccaagatcaactgtgattttaccaatcctttgttggttataatgtaatcccagtcaagaaagcatataactatgtctacctaattctttaaaatccagccttcaagatgtgggataaatcatccttatttttcctaaacattctctcagagctgtgatgaggtttttttctccttctggtgcttctctctccccttcccttccctccctcctctctctcacagatagcaaaaattaaggtggttccttgacaataatggtaaatgatcacggaatggagcatgagagggagtttttgcttgttgttgtttttgtttgtttgtttgtttgcttttgagatagagtttcgctcttgttgcccaggctggagtgcaatggtacgatgtcggctcatctcaaactccacctcccaggttcaagcaactctcctgcctcaacctcctgagtagctgggattataggcatgcgccatcacgcccagctaattttgtatttttagtagagacagtgtttctccatgttggccaggctgatcttgaactcccgacctcaggtgatccacccaccttggcctcccaaagtgctggtattacaggcgtgagccaccacacccggccttgttgttttttaaagcctaacaatgcttaatgtggctggggcaaggtggctcacacctgtaatcccagcactttgggaggccggggtgggcagatcacttgcagccaggagtttgagaccagcctggccaacatggtgaaaccccatctctactaacactagaaaaattagctgggcgtggtggctcacgcttgtaattccagttactcaggaggctgaggcaggagaatgtcttgaacctgggaggcaagaggtggaggctgcagtaagccaagatcgtgccaccgcactccagcctgggcgacaaagcgagaccccatctcaaaaaaaaaaagcttaatgccagaaaaaaatttttttttcagggaaataagtgagatatgggcaacttataagagagggaataattctaggaaaattctgtttaacctattagccagtctatcaaagaagaagatctctgtggcattgggtgaaactcttggtatgccacattctaatccacatagccttagaagggctctcacatgctcatgttagtaagtcagttgttatggagaaaggtgctttttacatctgcaaggctggctagtcacgataagcaatttaaatgttactgaacctatttcttcttgaggctgttgctgtatggtttcttgctgccagctcttttctcccaatatttttatgctatagttatcctttatctaatatatgctacacatgcaagcaaacccctttttgtgtgttgagaactatagctcctataaaattctggctagacccaactcagcaggtgtgttcaagtctgcttgcaagagactcgacagggtgaagggtggaaaaatgtcagtgaacattgtggttgtaataccaccttacttcacatttcccagtgactttttatgcttcatatagaaatgttcaaaacatatctcattgcatttcatttctagattgcagcgtggttgtattgtttttccccctgtactttaaagactaagtacactttcatcccagatattaccaaaatcatacagatgattcagcacttagacaaaactgcctgataattttccatcttcatcatttttcattcttgacctgaatcttttggtattgtgtaagtgctgcctaaatgaaaagtttttctttttagttttaagaaatgtgtgttataggccgggcgcagtggcttacacctgtaatcccagcactttgggaggccgaggcaggcggatcacaaggtcaggagatcgagaccatcctggctaacatggtgaaaccccgtctctactaaaaatacaaaaaaattagccgggtgtggtggcgggtgcctgtagtcccagctactcgggagactgaggcaggagaatggtgtgaacccgggaggcggagcttgcagtgaaccgagatcgcgccactgcactccagcctgggcaagagagtgagactccacctcaaaaaaaaaaaaaaaaaaaagaaatgtgtgttataaagcattcagacacgttaatatctttattatactttattatacataactctttttttctttgtttggaagtccctgctctttagcccattgcacaggcaactgttgataaaacacatagtctttttttttttttttttttttttttttttttttgagacagggtcttactctgttgcctaggctggagtgcagtggtacaatctctgctcagtgcagcctcaacctcccaggctcaagcaatcctcccacctgagcctcttgtgtagctgggactacaggcgtgcaccaccatgcccaacaaagttttatatttttttgtagaggcggggtttggccatgttgcccaggctggaaaccttatagtcttaatttctgatttctatgagttattcacgcaataactccacttatagaataaacatctaagatgaaagattttgataaccaaaattggtttaaaatgttactggaatcatttaaataaattagtacattaatatgaaggagttatttgcagtgataagcaaccatgttcttaaaatatttaatgaaaaaatggtactgatatcctgttgagtgaaaataaggaggttatagaatgttattactagatgatttcagttttgtaagatgtattttaaaaactggaaaacagccaagcatggcggcatgtgcctgtagtcctagctacttgggaggctgaggtgagagaattgtttgaagccacgagcttgagggtgcagtgagctgtgactgcgccactgtactccagcctgggtgacagagtgagaacccatctcaaaaacaaaaacaacagcaatcaaaacaaccttgaaaataatatatccaagtattaaccactgcatggtgggaatttgagtagtttttactttcttattgtgttttcttacatagctggaattattgttattattattattattattattattattattattatttttgagacggagtttcgctctgtctcccaggctggagtgcagtggcgcgatctcggctcactgcaagctccgcctcccgggttcacgccattctcctgcctcagccacccgagtagctgggactacaggcgcccaccgccatgcccagccaattttttctatttttagtagagacgaggtttcaccgtggtctcgatctcctgacctcgtgatccacccgcctcagcctcccaaagtgctgggattacaggcttcagccaccgcgcccggccatagctggaattatttttaaaataaacatgtaaagccaatttttttttttttttttttttttttgagaacgtcttgctctgtcgcccaggctggagtacagtggtgtgatcttggctcactgcaacctccacctcctgggttcaagcgattctcccacctcagcctcctgagtagctgggattacaggcatgcaccaccatacccggctaatttttgtattttttagtaaagacagggttttgccatgttggccaggctggtctcaaactcctgacctcaggtgatctgcctgtctcggtctcccaaagtgctgagattacaggcgtgagccaccacacctgtccgtaaagtcaattttaaaaagaatacaagcttatttttcaataaggaggtaatgcataagggagaaggcatcaacttagaaactgaatagatgtgggtttaaatccaattaagcattgattatacggtcatgaacctcataatgatgttttggtaaacgaaagatagtgtataaaacggtggttccataaagattataaaggagatgaaaaattcctattgcctattgactagcctttaacatcaatggcacaatgcattactcccaagtttatggtaatgctggtgtaaacaaacctaccgcactgttagttgtataaaacttcagcacatacaattatgtaaagtacataatagttgataataaacgactacattactggtttagatatttacaggatatgataattttttattttttgagacggagtcttgctctgtcaccgaggctggaatgcagtggtgagatctcggctcactgcaactccgcctcccgggttcaggcaatcctcctgcctcagcctcccaagtagctgggattagaagtgtgcaccaacactcctggctaatttttgtatttttaatagagatggggtttcaccatgtgggccaggctggtctcaaaatcctcacctcgagtgctctgcccaccttggcctcccaaactactgagattacaggcgtgagccactgtgcctggcttcattcttctacttacatatataaaaaataagttggtctggggcagtggctcatgcctgttatcccagcactctgagaggccgaggcggatggatcacttgaggtcaggagttcgagaccagcctggctaacatggtgaaaccccgtctttactaaaaatacaaaaaaaattagccgggtatggtggctcatgcctgtagtcccagcaactcgggaggctgaggcaggagaatcacttgaacccaggaggcggaggttgcagtgagcctagattttgctactgcactccagcctgggcgacagagcaagactccgtctcaaaaaaaaaaaaaaaaaaaaaaaaaaaaatcaactgtaaaacagcctcaggcaggtccttcaggaagtattccagaggaaggcattgtccctgtaggaggtgacagttccatgcttattgttgccactgaagatctgccactgggacaagatgtgaaggtggaaggcagtgatactgatgatcctgactgtgtagacctaggctaatgtatgtatttgtcttagttttcaacaaaattcaaaaaaaaaaaaatttaacatttcaaaaatagaaaaaaatacagagtaaagatataaagaaaaaaaattgtacagctgtacaatgtgtttgtgttttaagttgtgtttttacaaaagagtcaaaagtttaaaaaattaaaaagtttcaaaaggaaaaatgttacagcaagctaaggttaatttattattgaagaaagaaaacagaataggttttctttatactcctttataatctttatgggaccactgttttatatgctatcattgaccaaaacatcattatggggtgcctgactgtataataaatggttaattggatttaaactcacatctattcagttcctttttttttttctttccaacttttaagttcagaaggtatatgtgcaggtttgttacatgggtaaattgcatgtctcaggactttggtgtacagtttattttgtcactcagataatgagcatagtacccgataggtgggtttttgatcctcactctcttcctgctgtccatcctgaaaacttttaaagtaaatttagtgtagcctaagtgtacagtgtttataaagtctacagtagtgtacagtcacatcctaggccttcacattcactcaccactcactcgctgactcactcagaataacttctagttctgcaagctttgttcatggtaagtaccctatacaggtggacagttttgagctttcatgccatatttttactgtagcttttctgttttcatgtttagatccataaatatttaccactatgttgcagttgcctacagtattcaggacggtcacatgctgtacaggtttggtagctaggagcaataggctacaccatatagcttgggcgtgtagttggctatactagctaggtttgtgtaacttacactccatgttgcttgcacaaggatgaaatcccctaatgatgcgtttctcagaagagtatcctggtggttaagcaacacatgactgtatatgtaacctgaagctctcagagcttccctgtcttcatctatcagcccagggagaggaatcagtggttttccaaaagctgtacctctttccataaatacaaggatgaagggctgagatgatggcagttagaattatattgagaaatggtagcgggatctgagaaagcaaggccatgagttgaaagcagagagaaggcggttcgagtggagccctgatgaagttcatgctcatggttgcccagccattaacacgggctcatcacatctgtttccagattgcttctagaacttagctaccctcgttctataagatggaatgaaaatgcgtactacatacagatcatgaaaagacgcaaagaaaatgcatcttcacattgcaggtactcaattagatttatttctaatactcagcgccacccacaattggaaggaaagaagggctagaacattaaagtttctatttgtgctgagactgcaacttagctatttagaagttattttaacagacttccctccagtggaaaaacaaaacagggataactagtttgacttggtcttttttatctctttccatttaaacacagatatcctgttgtgataacctttgacactttattacatggccgcagtaaataataactgcccttattttgtaatgttagccctggttacacagcaccattaattactgaacataaaagttgaagtttttgtgaatagaaggaaatgttatttgaattcctttgctgggttcactaagtttatctgagggcttgggtggtataaatggcgaagagagaatcattgagttgtgtgtttgtcacagagaagtgcccccgcaccaaaaataagaaccagccaatctggggccagtgggaaaatgttgacagacttgcagaacttcactggaaatctgagtttgagtcacgatgaaattaagaaatcaacttccaaacaccctcaagttaccttaattgcttagagaatgtatctttagttacctttctcactataaaacagtactttttgttattgaaatagcgtttaaggacttgcaaaggaatgacttaaaaatcactaaaaatcatgtccatgtctttggaaaaagtcttggaaatgttttgccatcaatttccatattgatcaggacactgagttggagattttgtcacttttcttctttgacagttgtcatcctttgtcaatatttcttttctttcctttatttttttttttattttttgagacggagttttgttcttgtcacccaggctgtagtgcaatggcgtgatctcgactcactgcaacttctgcctcccaggttcaagcgattctcctgcctcagcctcccgagtagctgggattataggcacctaccacaatgtcgggctaatttttgtatttttagtacagacggggtttcaccatgttggtcaggctggtctcgaactcctgaccccaggtgatccagccactttggcctcgcaaagagctgggattacaggagtgagccaccatgcccggcctgtcaatatttcttaaataaggaaaagcctggttttataaagttcaaattttactgaaaattgtttttaattttgtttttgtattatcaacttttaattaacttacatttgaatttcagaaatgtttttaactttgtttcagggcgattttcaatttactcctaatctttctgaaacttagctttagtaaaatataaacattgtaatacgttacatgctcaaatcctacagttgtagaatttgaagcggccttaaagttcatgtattccatctctccaattagttaatcacagtattacagaatcattaatgttggcaatattttaatgtgaacaattgttaattgtgaacaattggctgggtacagtggctcatgcctgtattctaagcactttgggaggccaaggcaggtagattgcttgagctcacgagtttgagaccagactgggcaacaaagtgagacctattctttaccaaaaataaaaaattaggtgggcatggtggcatgtacttgtaatctcagctacttgggaggctaaagtgggaggatctctcttgagcctgggaggttgaggcttcagtgagccctgatggcaccactgcactccagcctgggtaacagagcaaaaccctgtctcaataaaaaaataaagtaaaaaggtaagttttacagatccagtcttaacataagtataaggcaaaatttaagactttggaataaataaaagagatattcttttggaatattcacattggatattctttcaatgaaatacctgtctttagagaccacgtaatcctacagggatatacatcttggtctttggctaagctattttacaagtctgttgagatagaagttaacttgaaaagtgttttactatagatttctgtattgatcacaacaattcagaaattgatgataaaactaatagtaatgcaaatatttcttgttcataatcatgcaaggaaattctgtcctgcggacagtcaactgattttcctctcttattgtggaaataaacagttttgtgtctacttgcaaatttatttcagtgttcccatctatatatgtatctgctgttggacttctcctttgaatgaatgataacatttcggtggttcactcattagtaatgagttaaataaaatgtattccagatgttcattttatgtctatatgatagtcatgattttacctttttgggaaaattatcctttaacctaagatacacaaatggccagtttataattaaaaactacttatcactctccattggcctatagatgaagacattgaagtttggagaaaaacagggtgagcatgtaataaatagcttagctggatttgaatccatgtctatttcatttctaaaatggtattctaactcattgcactgtctcgtcactaagaaataacatttttgtattttaaaagatggcttttagtttcatgttccagttgatgcttatatttccaaaacaatcatggtagtgaaatttgatttatacattctttcacctaagctctggctttcagccgctaggtttctctcttctgctttgactgggatatttctcttggctttgcatcaagtagtactgtgttttcaaagcctccatgtcatttacagtatgcattaaattgtatacaaagcttttccctttcaggacttgttaagaccttctgtttatttcaagaagaaagcctcagtgaggtgctatgtccctctcatacttgctagtctccctttcataacaaagagagagcttaacaaagagagttggagcttcctcaacaatagtatataaatttttgtttttattttgcttactttatggttatctcttatttattgaaaataattctgatttgcatttatgataatagcacaaagcttcttttaaaataaagttcagttaaaaatcagttgagataaaggaaatcattaattaaatagcttgactaatagatgtgagctctttcctgccaccttttccaccatgtgaggatgccatgagaaatcaccatctatggaacagaccttcaccaaacaccaaatctacctatgctgtgattttctttcttttttttttttttttttttgagatggagttttgctcttgtcgcccgagctggagtgcaatggcgcgatctcaaactctgctcactgcaacctctgcctcccaggttcaagcaattcttctgcctcagcctcccgagtagctgggattacaggggcctgccaccaggcctgggtaatttcttgtatttttagtagagacagggtttcaccatgttggccaagatggtctcaaactcctgaccacaggggatccaccatccttggcctcccaaagtgctgggattacaggcatgaacaaccacacccagccccacactatgatcttgaacatcccaacctgcagaactgtgagaaaaaaaattctatagtttatgaattacctagttggtggtattttgtgagaccagcaggaatggcctaagacactcatagagtcattgtgagaagggaataagatgctctgtgtgactgtgagcttcctgaggtcagagtgtgtctaactcatcttgttatcccccaactcctaatacagttcctagcacctaggactccataagagcttgttttcttctttcctttgcaaagctagttagtatagtcacatgaacattttcttttttcttttttttgttttttgagacagtgtcgctctgtcacccaggctggagtgcagtagcccaatcttggctctctgccacctctgcctcccaggttcaagcgattctcccacctcagcctccagagcagctgggattacaggcgtgcattaccacacccagctaatttttgtatttttagtagagacggggtttcactatgttggccaggttggtctcgaactcctgacctcaagtgatccacccgcctcagcctcccaaagtgctgggattacaggcatgagccaccatgatcggcccacatgaacattttctatggcattattaaacagagagtattgcatgtgaacacgtaaaataaacatgggcatttataatgttttatttttcctatggtgatcaaagctgttcaatgtatacatcgtatacaatgtatacatctgaagtatggaaatatgcaatgaaggaagaaaaaaatcatcccacaaatctcaccccccttcagacacatcacactccagggcaaccattcttaatttgataaatttctctttttttctataattaaaaatattatacacttgagatcctagtacacatgcaattttgcaacctgttattttctcctaaggttagattttgcttggcactcaaaatccatccagcatgatttttattgtttgacctacattggggcctttctttcccatctgtcatggggttggccaacagaatgtcaacctgtgaattctctggtaaaatgtttccaaatgacaaatcagacaatttggtgggaggattgatgcagggggagggggggtagggatgtattggggtaggggaagagggagatgaagggaagcagttaaggaaggaggcatgggagagagccagaggttcctcttcacaaaccgtattgggaggtcctggatacgggcatcggttccttggcaaagcttggaagccacccattaatcttgtactccctctgctggctttgctgagcacagccactgtgtgattaatgtgaatagtaatggtcctgagtccactgaaatcccccgtgatgaacaggaaagacaaacagtcattctttttgagattcttttttataagatccaagttcacactaacaggagtagattgattgattacttattcagttgaaacgaattcaaattgctgccccacccctcctgtcctcctcccctccccatcctcttttcctctgccccaggagaatgaaattctaaagttctcagcttttcctttcaagattcttatgattctcctgatgatctcacttctctttactgtattttgctgttgcttttctctgtttcaccttctgtgccaccccgcccacctccttgatagtgccatttgtgaataaaaaaggaatggtgaaaccctgcctttgctttgcaaagcagggttgcattagcttctctaattctgcagcctcttatttctccatttttgcttaattcaaagttgttaaaagcttttcaaaataggtgtatgctctacttgacagttgtgagaaaacaatgcctccaataaaaagaaagcaagatacatttgcaatttccttttccataatttatagtgatttagctcccccctatcaggagataaaaatttctttgggaacaagtttcttttaatagcatcatctgaagcagcacacatttctttcgcggtcattagagctcctagcctacaaaacagtgactgaagattgaattagatttagagggaggctgcctgtatcacataaataaacagggccctggccatttcattacagaacttagataagcagtacagatggtcggctgcagtgttacacatgcataacctatttaaaagatgacattatagggtcagaagcattaatgtactcacagtgtcatttgtttactctacttgagttacttctttcacactaagcgctaaagccgtgggtcaggcaaattattgcaggcagtaatgcagactagatgaaaagataagggaattattgaatgatgagagcataaacactaaattagtttaaggatttatggccccaagcttaacctaatagatgttatttgctattgatccttctcaaggtgttgtaggtgacaaaaaacccaaaaacctcattcgtttaagcacatcaagaaaggtaattaacttactaacttactggctcatggaactgagagatcagagcttcaggtatggctggttctagtgctcagaatggctgtcaggtctgttctctttcatggtggcttcatttgcaggatgctctcattactggtgttcagatgctccatgcctatgtattaacacttgcaagtacaatggaaagaggttctttgttattctagcaaaagatcaggaattacatctcttgaccaattttggatatgcgccttttctgaaccaatgattagaggtggaagaatggaatgtgtattccgttgagtcatgtgctcatcctgtgagccctgagtttagggcaggggttggtggagtttgtggatagcatcaccaagacagctagactaggagagggtggctcctcaaagaaaaaatccacatgctactaacacaggaaggtggtgtggaagccaggtaggcaaaatgggatttctaatccttcaaccagtgcacttcagaaaggatcattcactagaaccttcgaatgaattcaactaacatacaggatgcacgctgaggtaaaaactagaaaatgtccgtaaatctgttcattcacctgaggtttctgttccaagttaaatctattagcaggcaggactagcaaatattcttcataagtaaaactaccttatcggcacctgtctttttaatgctaccactctatgtttacactttcaaatttcccagtttctcagatgacagaaggaattcttactgtatcacatccctccatctgttgaattaaacaaaatgcatgccagcccttttaacaactgcagtactaaaagggtcaagtgaatgtcaaaggcatgattgaactaacaggttccggactgccaagtcccttgcaagactttagaaatgtttcttgcttttaacttctgctctgggtcacttacttgtggttactgtggtggtgccaccagctctctgaaatttcttactagtcaacagactacagtactgaaaggagctattgttacacttcagtatagaaacaggacacacacacacacacacacacgcaaatgagcacgtgtaaaacagtgaaatccaaatgaggtagacagattgtatttatgtcaatttctttgttgccatagtattctatagtgttgcaagttgttagcattgggggaaacagggtgaagggcacacgagatctctctgtataattctttataattacatgtacatcttcaataattaccaaatatttttttctaattttctcgagctggggtcttgctgcatatgtggtctggcctcgagggctcaagaaatatgtctgcctcagcctcccaagtaactgcgactacagccatgtaccaccacactcaactcctaccaaagaaagttttcaaataattgcataagacaaaaaactaatagaaataggattgtcatgaggatgataatgatgtcctgtgtcatcttgatgaaagcaaatctttgaaatagtgtgaatttttttttttttttgagacagagtcttattctgtcacccaggctacagtgcagtggcatgatcttggctccctgcagcctccacttcctgggttcaagtgattctcctacgtcagccacccgagtagctgggattacaggcatatgccaccacacccagctgatttttgtattttttattagagacagggtttcaccatgttggccaggctggtttcgaactcccgacctcaacttgatctgcctaccttggcctcccaaagtactggattacaggcgtgggccactgcgccggtcttgaatgtattcttttcttcctgcagactcaaagctgtggatggaagttgttgaagccctaggctggattaagaatactttagatttagtcatggcagagagttctgaaacaagttctatcaatatgtagttcaacaaatatttatttattttcactttcctttatttaaattgagatgaaacttgcataacacaaattaaccatttcaaagtgaacaagtcagtggcatttggtgcatttacaatattgtgcagccactgtcttcaattctgaaacattttcatcactccaaaattaaaccccatacctatttggcagttactccccaaccccactccagcctctgggtgactcccaatctgctttctgcttctctagatttacctattctgcacacttcatgtaaataaaatcatggaagatatgatcttttgtgtctggcttctttcacttagtgtaatgtttttgaggttcatccaggccatcgcatgtatcagtatcagtacttcattctgatggtgttcaggacccactaccctaaaatatggcaccttggcatttgagaacactgcagaagcaggaagttctctctgaccttcctcccacccttcacctttgaagtagactataaaagaatttttttttatcttctcctgaagtagggcataaggccctcattccagagatggccacactatactcagagaaaaatgccctgtctctaaggacacaggaactcggagaagaacctgaacaaacaggccttgctaaattctccctagttgattactatcagtttacaccccttttgtccaatggtactgctgcctgactatccatttgtcatcaaacctaagcacaaaaatgcataggtttccctgtttttttggtttttcatttaaaaagtctcccatatcacataaaatttgtatgctattctcttgttaagctgttttttctctttttttgagacagggtctgcctctgtcacccaggctggagtacagtggtgtgatcttagcttgctgtaaccccaaattcctgggctcaagcagtcctcccacctcagcctcctgagtagctgggattacaggcagcaccactatgcctggccaatctttctttttattttttgtagagatgggatctcactatgttgaccaggccagtcatgaactcctggcctcaggcgatcttcctgcctcagcctcccaaagtgctgagattaagatgtgagccactgtgcccagcctaagctgtcttttattgcaagcgcctcagctatgaacctagcaatgggttagaaaataaatctctcctctcctacaattttctttcatggctgaataataaaaaaaaaaaaattgccattatccattatatccattgtatgaacataacacaatttgtctatctattcatttgttgatggacatttaagttgtttctaccttttggctatcgtgaatagtgctggtataacatttgtgtacaggtatggttttcaccacctgtttccaattattttgggtatatacctatgagcaaaattgctgggtcatgtgacaattctgttgaacttaacaaatacttactgagcaactgcagtgttccctgtagtgctctacgtgctggcaacacaattattgagccaaaagttcagatccctccttttctggaacttaatttctaatatcaaagagaaaggcaataaacaataagcaggaatggtacctaatttgtgatgcaaaatgcaaatgaggtccctcgtttaaaaaaaaaattattggctgggaacagtggttcacgcctgtaatcccaggactttgggaggccaaggtgggtagattgcttgagaccaggagttcgagaccagtctggacaacatagcaaaacttcatgtctacaaaaaatacaaaaattagctgggggtggtggtacacacctgtagtcccagctattcaggctgagataggagggttgcttgagcttgggaggcagaggctgcagtgagctgagatcgtgccagtgcactccagcctgggcaacagagtaagaccctgtctcaaaaacaaaattaataactttaagatgagaacagcaaagccttaaaccaagtggggagtccttctaagtaggcacagtgtcctgagagactgcacactttgttggcctgtgaagctaacactgacaataagaaaatacagtaatttcagatgttaatcacacatgaatacacaaagtggggtaatatgatagagaacaaatataagtgggtgagctactttcaatagttaggaaaggcctctatgagaagctcatattcaagctgagacctgaatgataacaaggaaccaactgtatcaagatctctgggcagcgtatccaagcagagggaagagactgagccaagactgcaagcctgcaagttcaggaaccaaaacaatgtcactgtggctggaactgggttatctttagcctgagtgtaagtacagtttctaacaccacaatcctggaggaagatttgggcctcttttttggaataaagacagtgaaaatcagtcttggtaacatcaaactctagacccgtggttgtcagtgagcatgatatagcacactggtgttccccaagcacttctcagttagggcctagattttgcccactgggtacaatttattttgcatcaactgagaacacagagtatctgtcagaatgctgagctgaggattagctggttgtggtgtgtgtggagtacaatttggtactaacgagtggtaagaagcataccataatgccaaagattgtctactgggatgtatgcagaatgtgaggtttctgagagccaagtcctggaagtaaaggaggttgcaccgaggctgagaaaatagagtgatcattgtgcacacgttcatggaccccaccagatgttagactgactggagtagacagtgcattgcaatcattgctaactcattgagtgtctttttatttctttaagcatgacttcaaaactctaataatcataaagttctgagaaaatgtggagatcatgactctagacaacatttacaagaactgcataggtgaaagagtcagatgtctggctgacctagcagttctctttgcaactgaggaaggccacgccaaagaagtaaggtttacatccaggctgagactttttcagagccacgagggagtggtgggtgagtcagagaaatgatgcatgccagaagaaatcccttaagaattactgtaaaatcaatggattggaaaactgaattaatggggctggggactgtttattaacaatgaaaaaaaaatctatatttcccctgtcttctctgagcaatattagaagctatgagagaggagcaatgaatatcatgtgaaaggagaaagtgaagacaccagatcacataaatgattacatggagtctgaacggctcataaggtttgcatgagtgaatgttcccagtcgttctggtggataaacactttgttatcctagatcactctgaataacttgggccaataaaggcagtcatacttatttcaaaggacaccatatcaggttctaaagtggccttcaaatttattgcatttgtggaagtaccaactggtgagaatagcatttgtgattggtttcagccatgcaagggagtctagttacaagataattcttgataggggacagggtcccaaatccttctgctttgtttaaaaagcattgctgaatcagcatttgattcagagtgtacaatatataacttttgtttttttttaaatactaatcagtattggcaactttttaaagttataaaaagtgaagtgcctaggaaaaattttgtattctcatttaaagctaaataaacagatggaaatagaaattagaaggtgttccatcttatttcaattttcttttttccccactattatgacagttaaagaaaatcgctgaaaactagtcaaatccaaaaatattcctcacatttatttttcctcgcctgagtaaaatttcagagtgttttgtttacaaatgaaaactttaaaagtaattattttgtaattgttttgaaaaaaagcaaataactaataataacgttctacaaacataaagttaacttttgtgtgattaaagtttaatctaaaaacattaactttctattacctgtttaacatgaaagtagaccgtttttacacatattttatttttgagaattttccgtttaaaaatctaataattggctgggcgcagtggctcacacctgtaatcccagcactttgggaggctgaggctggtggatcacctgaggtcaggagttcaagaccagcctggccaaaatagtgaaaccctgtctttaccaaaaatacaaaaattagccgggtgtggtggcaggcacctgtaacctcagctacttgggaggctaaggcaggagaatcgcttgaacccgggagacagaggttgcagtgagccaaggtcactccactgcactccagcctgggtgacagagcgagattcagtctcaaaaaaaaaaaaaagataaaaatctaataattattccacttttgctatataaaaaaacctgtgtgtatatgtatttacacacaaagaatataatatggaaagttatatcccaaaatgtgagtaatcatcacatctaggtggtaagattctgctttttttatattttcatattttttctatatgaatatgtattatttgtacatatggggggaagagaaaactaatataagcaaagcattagttttctaatgtaactgtaatgacattaattcaaattctaataaattacattagttctaattaatgggtcaaagtcttggctataaacagatggcacattcaggatttttttaaaaatttcaatagctttggggttgtaatggtttttggttacatggacgaattttgtagtggcgaattctgagattttaatgcactcatcacccaagcagtgtacattgtactcactatgtagtcttttatccctcactcacctcccactctccccactatagtccattacatcagtcttatgcttttgcggcctagtagcttagctcccacttataagtgagaacatacagtatttggttttccattcctgagtcacttcacttagaataatggcttccagctccatccaagttgctgcaaatgacattgtttcattcccttttatggctgagaagtattccacgatgtatcttcccttcccttcccttccctccccttcccttccctcccctcccctcccctcccctcccctcccctcccctcccctcccctcccttcccctgccctccccgtccctcttttcttttcttttctcttttctttttttcagaacagagtcttgctctgtctcccaggctagagtacagtggcatgatgtcagctcactgcaacctcaacctcctgggttcaagcgatcctcccgcctcatcctcccaagtagctgggactacaggcactcaccaccacgtccagataattttttattttttgtagagatggggttttaccatgttggccaggctggtctcgaactcctggcttcgagtgatccactcacctcagcctcccaaagtgctgggattacaggtgtgaggcaccatgctcaacccacattttctttattcactcgttggttgatggacactcaggttggttttatatctttgcacttgtggactgtgcggctataaatgtgtgtgcatgtgtccttttaaatataatgatatctttttcatttgagtagatacctagtagtgggattgctggatcgaatgatagatctacttttagttctttgaggaatctccatactgtttttcacagaggttgtactaatttacattcccaccagcaatgtaaaagccttccctttgcaccacatacacactaacatctattgttttttgactttttcttttttttgagacagagccttgctctgtcacccaggctggagtacagtggcacgatctcagttcactgcaacctccgcctcctgggttcaagccattttcctgcctcagcctccccagtagctgggattacaggcgtgtaccaccatgcccagctaatttttgtatttttagtagagatggggtttcaccctgtcggccaggctggtctggaactcctgacctcgtgatccgcccacctcagcctcccaaagtgttgggattataggcgtgagccaccatgcccggctgttttttgacttttaaattatggccattcttgcaggactgaggtggtatgtcactgtggttttaacttccatttctctgatgattaatgatgttgagcattttttcatatgtttgttcttcatttgtatatcttcttttgagaaatgtctattcatttcctttgcccactttttgatggggacactcaagatttttaaaaaaggagagtcaaatggaatttaacatttgtggagagaagtgagcagggttaaggaaccaccagggcatgataaagcacccaggggctaggaactgggaagctgttaccacccgtagacacaaaggcaaaaggaatgggaacatgtttccagagcctggggaaagcttggggctgacaggaccatggcgaggatggagggctgaggacagaggggaagcaccctagctttcctttctccctcctagtctcaacccagtgaaagccttaggccctcctaagaggctggccttgactcactgggcatggtgaagagcaaaggacaatgaatgtgttggataaatggagaataagctgtgctgacagcacattgtgaagatacattctcagctgtgagttacctctcatacctttctaccatattgaaaaaggaattagtttccttttattccttcattttcttcttcctggttctttatagaattgatcttctaaaatgtagagatgttgcccaggctggtctcgaactcctgggcttaagtgatcttcctgtgtcagtctcacaaagtgttaggattacaagcatgagccactgtgcctggacaaaataaactttacgtgtctaccagagaccactttctcaacataggagcattagggtttgaatgcatcttaacaatcatttgtcaaggacagacatggtagccatctgttagtttttaaaaatctatcctttattccttctggggaaccttctctccccaacactgtaggatgtaatcaagagcacctgcttcctttgctgtggggtgcggtgtgactcaggctggataaacaacatgccccatctctgtggacatggggataagtgggtccatgacccattggggccactcagagttttttttccaaggagtgacatggactctagaaaataaagtatctctttatttatcaggaactgtcaggattatgttaagtctggagctttcaggagctggagttaggcagcttaggagtgcctaactttttcaccctggacagccttttggtgaatattgccagcatggagggaaaaagaactgaaagatggaagaaaaacacaggttagggatgacataattcaagcacctgaccctagcagccagaagctagcaaaaccccagacatctgttttatgtgccaacaaattttctttgcctcatatgttactttgaggtatatttctcacaattgaaactgacagtcctgactaatagaacctcccatgtggaggctgagggtaatagcagttagagttcattgtgctcttacgtgttttgttttcatttattcctataataacccttagaagaaaataacatatgattattgccattgtccaggtaaacaaactgaggtacagagaggtcaagtaatgacactaagggactaaattgtcattcaaatcaaacctttgctcaactgtaaaatgtgtgctcctaataagataactatataatttatcctctagattggggcaatttgataatgacaccaggataacaggcacagtcttggactgtctgaggcacactgcaagtcacttagctcttcaccattccaccatgactcttgtgatccttgttttcctgttgaggaaactgagatatggacaggttaagtaatttatccaaggtcatatgacagagtccatgggtggggaggagaaagattagggaaggtgctgcttggccaacctatgtttattctgtgaccaaacgtggggcttttcaaggttcataggctcctaatgcatggatcaatacaaagacacagaagatggaaattctggccatgtcaaagtcctgtctcaaagctcccaaaccagaagatctaaaggtacaaaggtgactttattaaaaggtagtgattgagccactagaacaacaaaagtattaactttaaaaaatatataacataggccgggcatggtggcacacacctttaatcccagtactttgggaggccaaggagggcagatctcatgaggtcaggagttcaagaccagcctggccaacatgatgaaatcctgtctttactaaaaatacaaaaattagctgggcatgctggtgggcacctgtaatcccagctactcaggaggctgaggcatgagaatggcttgaacctgggaggcggaggttgcagtgagctgagattaccccagtgcactctagcctgggcaacagagcaagactctatctcaagacaaaaaaatatatatatataatgatatatatatatatatatataaaatatatataatgatatatataaaaatatatatatcatgatatatatatgtaatgagatatatatatatatatatatatatatatatatatatatatatatatatatatcatggcacttggaggagcagtaattaacaggatgagtttgggctgtattagaagctatgagataatagtaaatgaagtagcttgtcccctggactggctggacattagaagtataagaagtagtaaatgaagacatctcttcatccattcacaaaatcatctggatttttcaggacttattggatatttgatagaccctctgttttagattgcagaggctggtagtgggaacccagctgctcctactgtctttcctttggggtcccttttgggtgtctgtgcctgtatggaatgggggacacatggggcaggtgcctagcactgtgctatgtacttacatagtcacgttctaatgccacaccgggaagcaggtactgtccttatgctattctacagacaaggaagctgagcctcactaaagttaaggaacctaggctaggctattcacccaacacatattttttcacatccttctctgggccagggaatgctgtggagtgctgagtgcagagtgatgacgatgttacatgtagttcctgccattgtggcactcatagcaaagaaggtatgtgccaagtcagccttactccactactccattctgcctaccacctccaataacaagcgggctgtgggcatgctaagcaaagctggtctactctgctaggttacgagggaagcagggggcagggagtgggggagataagaacaaaaggcattgggagcccagctcaggttgtgtctcactaccaagagacgagctgggccatgctagcaagcaatgtatttaaatgcatcacttgctttctattagtttgcggttcaagggaaaaaaataactctaacttggcttgtaatgtgttacacagcctgacccttagccacccctttaagctcatcatgaagttccatgcccaactctctgcaccccatgctctctgttcttgtggcagctcactgggttaatcctgctcctttctccatggagggacttacacatcatcctctccttctgacttgggtactttcctctttaccatccccatccttccaacacacccttctggtcttcctggggtaactgtgcctgaccaccctgatcaggcctcatgtacctctccagtgtagtagttacataattggcacttaacatttatttatgtgaataagtgataactgtctcctcaaatagacagtgagctttttaagaatagggactattcccctctctctttttttgctcacttttaaatattttaaattttgttaaatttataaatgtagtgctaaatatatctttgtagaatgagtgaaagaatgaatggatggatgaaatagaggtgttactgagtatgtaacagggcatctaatcaaattagggaagccaataacgatgtccagcttttgcttatcattgtctccctatcacctagcccagtgcttgagagatccgttatctaagcaggtacttctaaaattttgatgtttgtaccagtcctcgaaaatcttgttacaatgcagcttctgattcagtagatctggagaggagcctgagattcttcattttaaactgctaccatgtgattttgaggctgctggcccaagggctacactttgagtagcaagactcttagcaatataacatagttgcaagaggatattagcttcgagcaatacatcaatgaggatgcttttggttgcaagtaagggaaaccccagatcaaaatgacttacttaaaaaataagggtgatttattttgcaaatgaagaggcctgtgacagattggaattcagacacaatttcaccaagtctccagctctgtttctctgtgattctcttggtgctgccctccttggagtgtccttttcattttttggctgacttccttgatggtggcaaaatgatatcagcttttccagctgtcacatctccatatggtatcatctagtggaaataaaatcatctattcccccagccgtcaagaaaaggtctagtcttaactacaatttgactaacttaggttatatctggggtagggtgggagggaatttgtaatttatttggctgacgttgtctatttgctagcttcagaagtggtagcttatattgtcctagctgggtcctgatggtacacaggtgctcaagtaatcccatcttgtgccttgggtgtttgtacattccatgaaatcacaaacacatacatggacccttgccttcaagcatccacctagggcagtggttctcaactctggccgtttagaattacctgggaaatttttacaaatatagatgtctagatttgtaaaataagtttcctggggcaggaccccaatgatccaagtttttaaaagacccttgagggtttctaatgtgtagttaaggctaggagccatttacctaaaacatacttctcactccccagaggaggggattttctgttccccaggggccatttatcaatgcaatgcttggagctatttttggtcgtcacgaccaaaaattactactgataacttttggtgttactactgatatctagtggaatggtgctaaacatctcataatgcacagaaaaatctcttttcccctacacaaagaatcactgggcttaaaatgttgatagcattgaggttgagaacacttgatctagagggacaagatgttagaaccagttatttatgtgcaatgtattcgggcatactgataggaaaacacacagtatagaaccatggttttcgagctttattgcccttaagaattaacaggagtgcctgtttaaaacgaagtttcctgaagcttgactccctgaagtatagattcttccagcctggagtggggtccagtcatctagatgtttaatctgataaagtcgctgctgatgcaggtggctctgcagaccgcgctttgagaaacacaaccgcagaatgcgcagaatttcttttaatgtgtgctttcaggtgtgaacccaggcaaagtccagaaatagcatcacgaaaggcaacatcttgagccaggaatgcaagtctcctggtggaatttcaggcaccagcagtgggtgtggagatatttcgggctgctaaagccctggcagctcttccccttgctccttgctgggcttggtcttgtaaagccaaatgaaaaccccagctagttcacgatcttgtcttcttccgaggaaagatttgtctgaagacagtgttactgcttccaaagcaccgagggagctctgggggttttattgacattcgttttcacagctctgagaaggttatttctatcctttctgtccgtaatgtgagatgataggggaggaaaataagattccgtcaggagtgcgtggtttagccgagtcctttcacgtaatcgtgagctgtgatgagcttggttgattctggtctgagcgtctgggaagctctgtgaccaggctgtttatcgtttcactgcagtgcctgaatataaaactcgggcaccagaccctggctgtctgggcaatttgggtatgagaccgcagatctcacaaacttcagccatccaccctgtctccctgcgagaccccgggcatttatacagcactgcagatagacccgctgagacccacactgtagtagcttcagcagagggagctgattaaattcctctttcctttgctgcttgcattgttttggcagagattatcctaaaaatagcacagcccagtcctgcctggatgccttctgcctcatttctgcagggttgtacgatgtgtattattcttccacacttactgtctcatggaagaggcaatattctgtggaggaggaaaatgaaaaaccctgggctttggagacagaagactgcctttcaattctggctctgcctctgtccaacctcgttttctttttttcttttttttttttttttttggtgacagtcttgttctgtcacccagactgagtgcagtgacgccatcacagctcactgcatcctcaactacccacaccatgcctagttaatttttgttatttttagtagagatggggtttcatcatgttgcccaggctcatctcaaactgctggctcaagcgatccacccgccacggcctcccaaagtgctgggattacaggcataagccacagcgcccggcgggccttgtttactttggataagtcacttaaccctggcgaggcctagttttactagcttgcctataaaatgggcatattctaaaaccaatctcatggaatcattttgaaggtaaaatcagataaagtatgtatcagctcttcaataaacaatattatgagtattccctattctgagcagaccatgctgtccatcatctcaattatggcttaggtgtctttgtttagcccaacaccattcctggtacatagtaggcagcatgtgctacaaagttaaattcattatgtctcttcttgtctttatttgattaatagctgtcattcctgctagaattccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcatgcagtaaaaaatagccatgattattttgagtaaccagtaataaaacattatagaatagacattttctttaaagtatgtttgcaattttaacctgtttattcatcaatgtagttgattgttttatggccatccataatgatattttggatcacagaaattcatatccttttctaaagttgactttaaaaatgtataagtaatttgtcagtacaacacggtaagtgctagattagcacttgtgctccttcagggtaggtgttatattttctgcatttttgtaagtctaagatcaggcatataccatggcgtcagtaaactctgaaagagtgggggtaggaagaaaagatatgtgcttatcaccttttctcttatctcataatttaataattattgtcatactttttgagaaacatgtttcttaacagtgtgaatatatgtttaaactttgtgaaagactggcttgttttaaatttcagctgctgcattttttatcacctatgaatatgtgaagtggtttttgcatgctgattcatcttcatatttgacacctatgaaacatatgttggctgcctctgctggagaagtggtaagtaacaagttttgtgtataaaatacttcagaaatgcacatcatgcatatattttcagtacatatttatttcattttttaaaaattatttttaaattatgaaagtcataaatggcaataaatgtaaatggattaaatatgacagttcgaagatagagcctgacaactaaaagacagagccttatataggacagaagaagaattctagctatgtgtaatttacaagagacagatgtaaaacataattatatggaaaaaagacaaagagtggaagaaaatatccattcgaattgtgacagctttgtattgtgtcggtacaactgagctggaactacttttccgagaatttcctttccgaaatagtttcagtttgggtcagccacaagagaaatttgcatgttctttgtaaggtagaagtgaagagctgtatttctgctcagaaggttggtatatggtcaggcactgttgcagctcacacaccctgtcactgacttggctgtatcaccatgttgacgtttggcttccagctcctccagctcccactggttcttttccatcagcttctccaaattctaggtcagatttgtgggctctgtcatgaagggtgccagcttatactgcaaattctctgtcacagattggtgagaaataaatgtgacttccagtctgtccttgttcttccccaacttcacatccatctttccttccctgttgcctgccctttgatttctatcccaacactagatggagaagcaacagccctatacaaactgcttaattagctcccataattactggtcaaatctctataatccttatcactcatagtggttttgcttctgtgatgaaaccctaatactaattgaaaaatagtttgtggaataatattaatattaggaaaaaatacgtaaggcaaaaaacaaagagaccagtgcacaatgatactggaacagttctttcaggagatgtaacaagcccgaacctgcactgaataacatagtctcaaaacatataaagcaaaaactgacagaattttatggagaaatgaagaaaactgtagtcttagttggagatagtcacatctctctctcgaagtaggcataaacttactaaggccatagaagatttgaacaacacaatgacaagattggtctgttgatacatgtaaaactttgcacccaacaagtaaagaagatagactttttcaagcataattggaacttaataacaatagcccacagggccagttttagtgaatactgcagagacattgtcattacagatcattagttgtgtcattataatgaagtaaaattggcaacagtgacaaaaaataggcagtctgttcctaccatgtgtttaaaaaccaaactcttggccgggcacggtggctcacgcctgtaatcccagcactttgggaggtcaaggtgggtggatcatgaggtcaggagatcgagagcatcctggctaacaccgtgaaaccccgtctctactgaaaatacaaaaaaaaaaattagccgggtgtggtggtgggtgcctgtagtcccagctacttgggaggctgaggcaggagaatggcatgaacccgggaggcagagcttgcagtgagccgagatcaagccgctgcactccagcctaggcgacagagcgagactctgtctcaaaaaaacaaaaaacaaacaaaaaactcttttgtaaataatttcagtcaaagtagaacacagtactgtaagtggtaagtgtaagtgatatttattttttgtttctatttttgaagagatgggggtctctttatgttttccagactggtctcgaactcctggtctcatgtagtcctcctgactcagcctcccaaagtactgggatcataggcatgacccactgtgcctggccaaaattgatattttaaaccgaaatcgtaaacacagttatgattaaaaaaaaaaaaaaaacaaaacctcaaaactaatgcagaggagaaatgtataatacaaataaaagtttcttcattcccctcattaacttatctttctccctaccccttctgcacaatgctgagggacagccttttatgttgcttattagtgttattttcaaatcacacagcctggtattcatgcagtcttattaaacccccatccttgtgatgggcataatagaaatggacaacacagtgaagataaaggtcttaagtttgtaagccttttatcaaatcacacttttctttgtaattagaaaagtaatggcatatgtttacataggaaacttgggaaatgaattaacctttataacatttacattaaaaattgtgttatattgtgaatttgtttttgatgcactttttttctttaggaagtttgaacaagaatctacaaactgtttagtaacctaatattccttgtttaagaataagtgaactggggatatggaaagagaggtaacacaaaagtaaaagttaacatgaagaagatttttttttaaagaaaccagctttattgagatacagttcacataccatacagttcacccctttaaagtgtacaattcagtggtttacaccatattcacagagttgtacaacctttgccagcgtccattttaaaacatctctccccaaaggaagctcttacccattgcagtcacaatccccatttcaccccaaccctccccactcctaggcaaccactggtctactttctatctctatgaatttgcctattttggacatttgatataaatggaatcctacaatatgtggtcttttgttactgacttttttcagctagtgtagtgttttccaggttcatccgtgttgtagcatctgttagtagttggtttctttttaaaattaatttaggtgattatgtcctgacacacagtctcgttacatgcagttagtctggagtatgtatacttacatttgttggtacattgttgagagcaagcaacaaaaaaagaacctggccacttcatttcacctggggccatcttgcctgaaagttattttgccatgttgaagggcaggctttcctcagtttataaactttcagtccaaaaaaatagaaagtgatataataggtagggcatatagtagctattagatttctcatgttaatcatacatctttttatttgtagaaagtcgtttatattctgatgctcctagtatctgtaactaatatttttaaaaaattggagccttggaaaaggctctaagtttctaagatttacaaatattatgtcataacatttgatatgtggactgttaggcatgggaggtggggtaggtagattttagaattaggaaacaagtatccatgagactggagatacaacagataaggacattcttacctacattgtgtcttttgggggttctgtggtccctgagctggtaaggccaattatcaaacacctatttatagttgctatggagctgggctcttggtaatttgcccatgttggcttcagactcttggcctcaagagatcctcagtagctgagactactggtgtgcgccaccaggcctggcaattcctagagaatctttgtttttattttgtttaagacagagtcttgctctttcgcccatgctggagtgcagtggcgcgatctcggctcactgcaacctctgcctcccaggttcacgccattctcttgcctcagcctcccgagtcgctgggactacaggcacccgccaccacacccggctaatttttttttgtatttttagtagagacggggtttcaccatgttagccaggatggtcttgatctcctgacttcgtgatccgcccacctcagcctcctaaagtgctgggattacaggtgtcagccaccgcgccaggcccctagagaatcttaagaggacaattggtcagcagtgggtacatagatttaggactttacacatgaaatacttcttgatgttggctatttaaatataaatataaatatatatatatatgcacacacacacacaaatgcacacacacatatttacaaatgaatgaatgatggggtctcactctgtcaaccaggctgaagagcagtgatgtggtcatagctgctgtagcctgtaacttctgggctcacgtgatcctctcactttagcctcctgagtagctgggactgtaggcaggtgccactatgcctggctaattttttaaaacaattttgtaaagatggggtcttactatgttgcccaggctagtcttgaactcctggcttcaagcagttcttccactgtggccttccaaagtgctgtaatccagacatgagacactgcaccctgccaatattgaccttaaatggactttaaattcagttatggtttagtatgctgagaagtttgccaaatttatgaagtttgtggaaatattggttctgatgctctaataatctttgatcttaaacttcctgaagccattcagtatgaattttctcaataaatgcttatatacatattacgcctttctttttttagtaacctgttttagtctcatagaagataaacttttgatttcagattcatggaagtatggttgccaagattaagagaaaccaacaggtgaatttagaggacataaattttcatttgtaaaataaaaagaaataggaatagaaaacatttatagctgtcaatggtcagaaaggtatagtaacctagagattataagaaatactttagtgcaatcattattctgtaacacatttgctttgatagattattatgttagacagattggttagaaacaataacatattttgtttgtgttgaatatagccacagttactttcttgtagcaactattaaggaaacttagaaacaaaagaacagtgccaaaataataaccattccctgtagcaacagcttgattaaaacttaatgatgaatcagtgaaactataattacaaccttctaccttatgtttgcaatttagaatacagtaaaatcagtcaaataagatttaacatgtaacagtagcaagaggggtcctgcttgtgccgtttttattaggaagattgctgtgccaaatctctaaatctctacctcaataattttccagctcagttttcatcacacacagaaaaagccctttgggaagtagaatctgtaattagatcaaaggttggggcaggtttactttaacggtacatatgctataacattctaatggtagtgattttcttttcttcaaaggttttaagatttgacgtgttgtatcttatcctacttttgtctttattcatattgtcagaaatgaaaaaaacattgaaatttcttcacccttgaaagcagcaacactgtgaatgtaatgtatgttcataggtgacatgtacatgtcctcatacacttagatgctggtagagtgtccttttcaagtgtcctttatggtcctgttctgacttgggattgaaaaagctaggaaataaatgatatcatgttttgtaaatgtttttctgacagcctctaacagtacttccccaagaaggcccgatgagcatctccccatacttcaccatcagttgcgtaggtagctagttacaaatggggatttttggagatgacactagggttcctgtattttaaacacaatctctagatgattgtgcaactcaccaatatttaatgccactgatctaggcacataaaacatctgaacttacaccccagtagtaaatatttttactgaattggctcagtaattccctacataatattttagtaggtgcacaacactgggtgtggtgtaccacttgtagatcaaatgtgttattctttctgttctcctcaaaatgacatattttagacctaaaaaggctagtttaataaactggttatttttgagtgtgacaatgaactcagacatgtagatttggatttaactggagttagaatgaggttttctccaaggcccatgctgtcatagagcctcgtaggcaaaggcagcttgttttatggtttagctcctttagtaactgacaaggccgttggaccccctttgtaccacagtccattccagggtctcctttggtatcagcatatggggcaaacatgttcttattcagctttcccactggttaaaggattggacgcatagatgctgtgtggtgtttttcagctccagagcatggtgcacattttactgagtttttccctagttgtggcttaagctgttttgtttatctacttaatatcatgctttaaaaatgagtacgtagtattcttcatgatcttcactggccttttctaagaagaaccactgagcaagataatagaagaaaggttgacaacttttgaaatgtattttatcttttgaattaatcatgcttttgaaatattcatcgatcaatacagattatctctcccttgcagctggaatattttgccacatctctgcacagttgtataagtgagtcgtgggggataggtgaagtagaagataacatggctgccctgagccacagtgaaatgtagctgatgatggcaattgcttgtatataaagatgaatgaaggttcatcaatagtgtatgactattaccaggaaacacagaagctgaaacagaactgtcagatacctgagtgcactcaaacaaacactttttttgtgtgatgtgtctaagcacatccatgtattatgggacctttcaccctattttcctgtctgttgactttttcaaagtgtgtctgggagtcttccttcagggcattaaatacataaggcaggcagacttttaaattccttcttagcaaccctaaaccataagaattacacaaaaaattatctcaaccatataaaaagcagtttgttttccagactccttttattttgtattatttcctcacttgtacatctttgattcttttttgtaataggttgcttttgttcagctcatcttagattccttcaccacttctatggtccttacctagtgatgtggatttagatctgaagttcctaatacgttccaggcattgaggatgaaatgacaggataagatactgccttttagaggcttgctgtaagtgcactaaagtgttacaggcatttttaagaaaaggaactatagacggtccgtgacttacgatggttctacttaaatgactttacaatggtgcaagagtgagatgcattcagtagaaactgtatttcagattttgcattttgatcttttccgggctagtgataggtgataagatgctctctggcaatggtgggcagtgcatgtcccagtcagctgtgctggtgtaagtattctgagcaattttagggaggcaaggctaaagcaatgatgttccgtaggttggggggtatcacatgcgttttcaacttatgatgggtttattgggacataaccctgtcataaattgagggtcatctgtacaaggtagagtgagagactgaagggaaggaggggttggttttctccggactggggtagatggatgggtgttaattcagaaaaagcctcacagaatagccaggctttaagctgcatttaatttaattcattaaaaaaattgtgcatctatttaaggtatcaacacaatgtgggatacgtatagatagtaaaatggttgccacagtgaagtaagtcaacatatccatcatttaacataattagtctttttgttttgtgtttgtggcagggcagctaaaatctgatttagcaggagtctcagttatagtacaattttattatcttgcatttagaataggatggtttgttaggtgggtgggtgcaaggaggggtgttagagttctgaaaagaccttgttaggtagttttaagttccatatgtttggagcacagtatgatagggtcaccctgaggcgaagcaggggctgagagctatagggccttgcctgctatagtaaggagttgggacttttttgatcagacttgtaattttaagaaagtcccctggcagctgtgtggagataaggagactattaaaggaatccccaggagagaaccacagctggggcagagggatgcagagggagagagtgagttcaagagatgttaaagaggtagagctggtggaaagatgatcattctttcaggagcccttccagcgacatccttcagtgcgtttttcatcatggatgccttttagtttgttgtgtctatgtgtgttgtgcacctacttgaattctccaatggagtctaccgagctaagttgaataagcatgccccatcttgccagtgggcccagccatctgagtctgagctaacacgcagagagggaaagaagacgaaagagagagagggtcagaacgggagggtcagggcttcccctggcttggcattatctgtgtgtggttatgaccttgcttgtagttattcatctatagtacaggcatgaatgtgctgaagagatttatcagtgaggcctgtagaaaggaacattgtaccccatctgcatcctcacccccagtttctcgatgagttccttttctaacatatttcagattgttttctgttgtatggattttctttttctaatatagtatgcagtgttagttcagatggtattgattcatgacctgggagagtatatttcattgatttttttatttagttagtggacaaaaaggaagggaagctctgttaactttttatttaagagctgcatgagtttatagaacacaattaagttgagctttataggcacagtatgattttcatataggttgatgaagttgaagaaacgattctgagccacaggagtgtaacttggtcagttattgccactgcattgtaaatggaaagactgaatactactctcaaaggaccaaaataccaaaggaggttaggattggccacttccaagcgagcctgaactctgtcagtgacaaacctttatttcctaaaatattgccttgttaagattagggttcttgaattaaatgcaactgtcacttatttgctttggtttgtgattgtgtgcttttcaatatttgagttgtatagctaatactattaataggtgctaagagacaccgaataagaaatttgatccccgtttttgaggagcatataagtaagttggatccatctgttaaataactagggagtatttgaggatgtctgtagggaggtagcaaggtatggaccatgggctgtcaagttacacagatcggggtcagatttgtgacttgtccacttatttgtctgtaggccatttacttgccttcactgaaatgctcttttcctcatcttgaaaaaataggattaatgccatcccagtcacagttcttacaaggatgaaattatacagcacttaacaaagtgtccagcctagcatctgacacacaaaatattgaataaacattgggtctagccccatttcacacaagttgctgaatgcggcacgtttttagaatttcctagttttgggaaaggtatctattcagaaggtgaaaaaattgaaattcaaagaagtttagtgatgtgctccaagtttcccagctattattattcccagctaataataaaacaccactgtagaataagtaattagataaatatttctctgtatacttccaggagcacctctgttttctttttcatgtagtatttaaaaaatggcagaagtagcggtaagtatactacttgtgcagtaaggattcacatcactggtttcttaaaaggtcaggttccaaaatttgccgttggttactgtgataggcaaaataatgcccccccccccccataaatatgtcctagtccccaaatctctgaatgtgtttcttcacacgggaaagagatttggcagataatattaagaatgttgagatgggggccgggcgcagtggctcatgcctgtaatcccagcactttgggaggctaaggcgggcggatcgtgaggtcaggagatcaagaccgtcctggctaacacggtgaaagcttgtctctaaaaaaaaaagcaaaaaaaagttagtcgggcatggtggtggacgcctgtagtcccagctactcgggaggctgaggcaggagaatggggtgaacttgggaggtggagcttgcagatcgcgccactgcactccagcctgggtgacagagtgagactccatctcaaaaaaaaaaaaaaaatgttgaggtggaaagagttttctggattatccacgtgggcccagtctaatcagtagggtccttaggagaggggagcgggggtcagagagctgaagatggtatactgctggtccaaagatagagcgaggggccacaaaccaaggagtgcaggggagccctagaaagcaggaagtcaacattcccttgcagcttccagaaggcatactgcctgactgacatctctcggtcttagctcaggaagacccattttggaattcataccttcagaattatagataataagcttatgttttaagccactaaatgtgtggtgatttgtcagagcagcagtaggaagcaaatacagtcaccattgccacctcctcaacgttcagatttttgtattggtgggaatctataaatccatccatgggatgtttgtcacctcctgtgaaatcatggctcatttctgttatggaaaaatacaaaagcaaaaaagccatttgaggcttatcttttgggttgtataaaattctgtgaacaaattgtagacacagggactaagtgttgatagagttattttctttgagaagacttccttgtgtagtctgtattacccgtgacagcagtcttgtcaggcgagggaagactaatacctacaacgattgaacttatttgcgtgattggaaagagtcttataagggagaaaggtttgatgaacataggtcccaatgcaagtaggtaaaaattaaaatctaaggagtgtaagttaggatttgtaaattggttttgtcaacagctgtaattccatttatcaacagaagatggcagacttgacacacaaatgaactgttgtagaggtttttgattttttaaatgatggtatagaaagagatgtaaaatattcttaattggaaacctgctttctaaagagaattttgggaattacaaagagaatgtggaaatgaaatacacgtaagcaaattgcatttcaaaaatcttcatagtttccaggggtctctccctgaccccctgtcttactaatttgccactttgagtttgctctggaaagtccaaagcagcttttgctttgaatacgatgaagctttgagtggctctgttcagtgtattgttaaatttctgttgaattggttatagagttgcctgttgaaacatgaagcattagctgaaattaaaccttgaacctctaagtgcattagatgtgtgtaagtatgacatctttattgaaaaataattctggagatgatagtcagaacacttgggtttcacccatgcttcctgagctaagtagctctctgaccttcagcaacttctatgatctcagattgatttatatataaaatggtgacataattagcttctaatatcagaggaatatttgcaggtagttgatggagtttcttggagaaaaatcttaaatcagaattttttttgtgaactatgttgaaatagttgcgaagaagatgtaatgttaataaaaggtattattggggatacttagggactttgaagagcatttccagaactagaggacagggtgcagttgtaaaaccctggtggtgatgtgttgaaggaagggaacttggctgtggcaatgaaagaaccaggggttttagcagcatccatctctcttttcctccactcagtacctaaagtgaggccgaagttcactggaattttttccctttcaaatgtttagttttatgatttgtagtcttgcatcttgggtttttgtttttgtttaaagagacaggatctcataggtggcctaggctggctccaaacttgtgacctcaagttatcctcctgtcttcacctccctgagtagcaggggcagcatgcatgtgcacctggttcttggtgtttcatttaataaatatcaaaaggaaacattcagtccttagctgcagcagtcaattaaaaacaacagaaaatattttatttatgccaaaggaagaaaaatcttggtagcagcatcatgatttaatcaacattttaatctaaggtttcatattttggcatatttaaggaggccagcattgcattttgattttgataaagtatggagggagcatgttttttttttttttcctttatggaaaaccttagtagttcttgtttttagatagaactttaacatttaaaacattcttggatttagtgaaaatgccaccattcctgtgtcatggattcatactgaacctcagatttataaggaaagaatgctttacagaatggatttaccaagagacccacagatgacattctgtttcctttcatagaaccataatactgtaacatgtttttgttcttgtgcagtgaaatactttgttgtagctcaaattcaaatctaagaaggatcagagttaatagaaaaccaaatggaaggctccggaggtactggaggaagcagaagcattactttgtagcatctctcatgccacagttgtcacccagcagaagtcaggaagccatgctgggtgctttgtacccctcagctagttagattgattttttatcggagaggcttttcaaagtttttcttctgcatctgtatttttaagaactaaagacacaatagtaagaacttggagggttatgaagcatgaagttccataaatatttataccaaaccacagaagtagacagttcctattttcttcacatattggggtcggatttcactcttgacctcttgaattgaaaaatacaaggagttagtatacccttttctttctcttattttttcttatttatttattttcagttctttaatgagttttagatgctgggagctgtcctgttaggttcatgtaggtttcgttggacttatacccaattttaggccttactggtaagctgtttaatctgtttttgtggatttattgctactaaatttataatatgtcctttttatcaaggctgataggttgccatctaaaagcatattttaaattagcccttttattttatttttcttcctcacttaaaatctttggtccataataaatacttttttcctttgaaattatgttaaaaacttgtgaaataataataaatgtgaattgtagagaatttagaaaatataggtaggtagaaaagaaacacctgtaattctactctgttttttccctactctttacataagtatatgtataggcaataaatatatgtagaggcaaaacaaaaaaaattaggctggacatggtggctctcgcttgtaattccagtgctttgggaggttgaggcaggtggatcatttgaggccaggagtttgggaccagcctgggcaacatagcaagatcctttctctactaaaagatgaaaaaattagcagggtgtggtggcacacccgtagtcccagctccgcaagaggctgagatgggaggatcacttgggcccaggactgaggctgcagtgagctttgaccatgccaccttactgtagtctgagtgacagaacgataccctgtttctatgtatatttatatgtaaattctaaagtatggagaagtcatttctgtggaattgatgattatttttttgctgattcatttcctcctggctagtttcatttgttttcaacataaaataatacaccagctgattagtaagtttgatgcataccatcttcttgctgtcagggtgcttacaatttagtagaagaggaaatatatttcacaaactatatggtgtaagctagtaagtaaaaaacgtcagataagaaagcttatttgggaattaagaatacagagggagggaatcttttgaggttagataaggtataattttggaaaattaagaattatagaaataaggacctaaaaagataccataaagatttctggtccaagtcaagtaagaaaaattatacatatatgcatctaattgcataaatatatacattattatttgtcaattttcttcattttaaaatgaattaaaaaaaaagaaaagactctggaaggccagggaaacacctgggaattcacttgcagaactggggccacagtctagggccgcagaccctcagccagaccactgctcattcctccctggagttgagccctgaaccaaagatccaggtttgatgcaggagtgaccccgaggctgagggatgggcctggtaaagggaggtagtcatagacggagagtcatgggctcgggcctctgactctaccttttttcatttcctgtggggtcttcatgtattatttcacttctttgctagattatcagcctttctcttgctgatagcactttcccccatcgtatgtgcaaatattgactgtgttaaaaccacactattccttgaccctgtggccctcttaactctgaatccatctcctaacacctagccatcttcacacgacggtagtgtacacttgctcatctccctcaatcccttatgaattgaccgtaatggatctcccaccccagccactctatggaagcaataccggtgaactctgtaaaccttcatatgtgcgctgctcgagactcttgatgcgttgctctgccagtctccatttgaggcttctggcccccttgcacatcaagtagggtgcttggttgcttgccatcaacattgatcctggctaacttatggaatgaagaatattttttggaagattggcagacactgttgccttccacttctcctttgcccacagaatactgatttggtttgtgtctcatgttcctaacgctttgctagatctagatatcctccacctccctaacaaggggtggccatgtcacacaactctggccaacacatgcaaggagatgtctgcgggggaaatctgagaaaagggaggaggcctgttctccttgccttcaactctgttgtgtgatagggtggtgctggaggacgtaagagctgtcttttatctgagagtcaggatgcccaggatgagaggccaggaagctgggtggctgggtagaaggataggaagagcctggcatcttgttcactttgaagttctggactaaaatttgaactgcctgtcaccaaataacttaagtgacttaatgtcatttgtagtcatggtcctggcacttgcatctaaaaaagcaattatttctgtaaatgaatgttcagctctcccgcttgctccaaacagcactgttcaatggagatataatgtaagatgcaggtgaaattttatattttctaatagccacattaaaaaaggtgaaaacatctgctgggatgaattttaataacatattttattaaaccacacacatccatggtatttagatttcactgtataattaatgtaaaataattattaattgggcatggtggcaccacctactcaggaggccaaggtgggagaattgcctgagcccaggagttcagggctagcctgggcaacatagtgagccctcatctctctcttttttcttctctttccttttctttttttttttttttaattattaacaggatattttacattaattttttataccaagttttcaaaatctgtcattttaacacttacagaacatctcagttgtactagccacttttcaagtgctccatagctgcatgggctagtggcctgcatatttgccagcatagctctagaatcagacccctggacgggagtgtttgattagccagacctaactcacctgattgtggtcctcctgccagggtaggaggggagagactgactccctttgtttttcctaactgggaagccccccacacgtgagagtcggaagctgggctgccagagaaggcaggtgtgccctgcaacattatgtaccgccttccagtgttgcttgctctttagaaatttatgttcccagggttccattattggctttgatcttcctttttggttctctctttgggtgttactatctggttttagcgatcacctgtatgctgatgacttccatatctgtattcacatccaagaaaaagttactttctagttttatagccatatattcatttcttgactggacatagccccttacctgtcccccagacttcaactcagccttgcctagtctgaacttacctcccttcttccctggactgctaatctcatgttttgggaccaccatatgcctattatccaaaccagaaacagaagcatcttactgtctccctacttcttcactccttaacctcctgtcagtgaccaggtccggtgcattttactcctttttcctcagatttgaccttctctgagccatattcatttccagatgtcttttatagaactgctatagcagtctcgtaacccatcttttgccttctggctcgtggtccccctttgcttcttgccttcctccccaccctccagctgtcctgtgcattgcagccagagtgatctccctaagcacacgtcattcctctgcttcagctttttcaagtgttcccactgactatggaatgaagtttcagccccttagcatggtatacagggccttgtctgtccagtcttacttgtcattactcctgaccttgcacttgctgctttggtaatacggaatggtgtgggcagctgccagctttggaatactgtgttggtgggactgccgctgattcccctgaacaccctgcttttgtatttatgtacttccttttattgttcattcttcccactgtgccctttccacctttcttgccagctcattccggctcatccagaaggttctataatggtgtaatcttgggcagtttctctgaatctgggggttggactaaatacccctcctccacatttcccataatctttgtccatgcgccccaccccccttttggccatgttttattgaaattatttatatgtatttgcgggttctttgaagccagggcatcatcttagtcttctttatcatggagtggcttgtgtggtatctggctccatatgtatttcttgaactgaattagataagtttgaagggagactgggtggaaaaatatgttggcccaagttacagacagctttatacataagaagcattcaaatgttcagtgaatgaagaaatggaaatcagatgatatcgttttgtaaatcttgtcagttttggtagaaaaataacttcaggttatgaatcctttgttaacataaccataccctttgttgtaatgcatcggtatgaagcattgttacttcttagctttagaggcaatatgcccgtgttagctgacttcatgacatctaaaatcacatcacatggtgtctttgtcccacttgtcatggggtgctcgggcttatatctgttctgtgcccagtctgctcttgccaaggctaattcccttggagtaggagttggcaagctgtcacctgtttttgtaaatatagttttattggaacataggcaaacttttaatttatatattattatgtatagatgcttttgtgctaaaacagcatagttgaacaattgtgacagagaccatgtggcttgcaaactgtaaaatatttcctatttggtcttttacattataaatttgctgtagagccttgccttagaaccatttaattttggacaggcaaagccttatgtgatatccaaattgagtactgatctctgattaggaatcaggagaatacggatcataaagggcaaacctctttgagttgtgtactctatttggtggaatggttttcttacatttcttgcaggctggtcttgaactccagggctcaagcgaccttcctgtctcggcttcccgagtgccataactttcatgttcaaggttacatatgtgaaatctaagttgcagaaaaagtttgtatatttgcagactgctaggtgcatagcggcttaaatacaggactttcattaaaatgtttaaaatatttttacacatctccctccctgtaccttgccaccccttctccaaccttgccttctttgcttttgtgggcagagttcctttgggtttgactaattctttattgtttctatttctgaaaataagtaaattaccttaatatagggtaaggtaaaatcctggcagtgtggatttgagatgacatatacccggcctcagcatgtcaccaagggtgatattagaatcatatattggctggtagctgtgaggatgactcaagtctgctggaatgctggaggagagtgtatgagagtgctgggagtcccttttcagttgctgcatgatcaagaggtctaggggctggagttggtgaagggtggaaggctgggtaccagctgatggtcagcttgcctctacggatgtatgcattacttccagtaaagcagaggttcctctggttcatttttcatcacacatgtttgaaatgtcatgtgccagttgcagttctgggcgttggggattcgaaatgagtaaatgtgcttcttgccgttgggaggcttgtagacagatgttcttggaacatctggcgggaggtggcaggatctatataggacaagccaggaaaggttctgggctgacaaaacaatgtacatgctttaagggtccaagagttttaggttaaaaaaaaaaaaagaaactttttgacatcttgcagtaagcctacatattatacctttttactacaatttttgcttaccaaaaaatttcaatttttatagcagttatttactttttaggatataatcaaatttgtcttttaggttgcctgcctgattcgagttccatctgaagtggttaagcagagggcacaggtatctgcttctacaagaacatttcagattttctctaacatcttatatgaagaggtgagatgggttttttaagctcttcttttctttattaagattttatagtagctaatacgaacactgtggatttcatcctaagagccttagagaaaactttagagctaaatttaatgtccagttatagtaaatttttgctaagattatctttgccttttattggtttttgaatattttcatttacatgtttttcaaatttctgagcataacattgagtgtcctgaattgtaatcttcctgcagttcttctggaatcagatgtgaaacaaattttaaatatgtaaaatgaagaaagatattatattaaaacatcagtatagtattttaggtccatggaagagatttagtactggactgataacagtgaccaatgtcataacgtttataccaaaatgtagcttcttttacagatgtatttgaagctgtcagtcagaaattattcttcctgaccatgtgactagagagcatttagctgctttcctttatagtttttatggaagcctttttttaaaaagacatgagaatcaatcacatgggaattttcaaagagtcttgattttagaaaagttatttgtaatggtgtgttacataggtgaggagacattgaatatctaattgtacaaatgagatgaagctagtataacttccccgttgaactatgtggatggttaatccagggttgtctggaaatactgaccactagtttgagagattatgaatgaatttctgatgtttgaggctataaatataattgtttttatacaaaaggataattggcatttgtaggcatttgcttttggaaatgtatttaaagcatctcaaatgttcttttcaagagaacacatgttagagcaattaagtactatataattaatatttagtagaataacagcaactaaaactaagtaaatatgtagtcagttttattgttagagatgttcctgtttcaaagagagctaatctgagctcccttaggagctagttatagaggtatataagttatataaggtatagttatgtaccttaggacagtttagaatcattaacctcttagagaagtgtggcaattgtgaatgttctagaactcaaacaagagcaggtagatctgctgtatacagaatgtccttcagaaatctctgccattctttctgaactctcggctgtgtgtttgtttcagggtatccaagggttgtatcgaggctataaaagcacagttttaagagaggtaagtcacttactttccaatattgaagtacgaaagaatgatgtcctttgttcagtaaatttatactacttaacaattagaaatatatttggagaaacttggtttaaaaaatcaaaaagggaaattatcgtcactcttctgttaaattttctgagtttttatatttaaaagaatgagtagaatgggtttgccggaagagcaatttcagtggtcagaatgacccatgttgttactgacttgttattctagggtggctaaatgtctcttatagttgaagtattttttgtttgtttttttgaaatgcagtctcgctctgtcacccaggctggcgtgcagtggcgcgatctcggctcactgcaacctccgcctcccaggttcacgccattctcctgcgtcagcctcccgagtagctgggaccacgggtgcccaccagcacgcccagttgattttttgtatttttagtagagatggggtttcaccatgttagccaggatggtctcaatctcctgacctcatgatcctcccgcctcggcctcccaaagtgctgggattacaggcgtgagtcgccgcgcccggcctcccggcctcttatagttgaagtattaagaagtaacttcgggtcaggcgtggtagctcacgcctgtaatcccaacagtttgggaggccgaggcagaaagatcacctgaggcaagttcgaaaccaacctggccaacatgacgaaacctcgtctctactaaaaatataaaaattagccaagtggtgggcacctgtaatcccagttactcgggaggctgaggcaggagaattgcttgaacttgggaggtggaggttgcagtgagccaagatcgtgccactggattccagcctgggcaacagggcaacaagagcgactctgtctccaaaaaaaaagaaataactactaagggtaagatatcaagtttattactgaattttgaggaactaatgaaaaattggtaatgaaataagccttctaagacagggaccccaaccccagggccgtggacgtgtactggtccgtggcctggtactagtctgtggcctgttaggaactgagccacacagcaggaggtgagcagcaggtgagtgagcattaccacctgagctctgcctcctgtcagatcagcagcagcatcagattctcataggaacacgaaccctattatgaactgcgcatgtgagggatttaggttgtgtgttccttatgagaatctaatgcatgatgatcggaggtggaacatcttaggtggaacagtttcatcctgaaaccacccaccccaccactggtccatggaaaattttcttccacaaaacctgtccctggtgccaaaaaggttggggaccgctggtttaagaggtggatgtctcagaagtctgtatcaggcagtgagcccttggcttcttgataacaaaatatgagctgggaagttcagtctggactggagtcctggcactgcaggtgattcacagagcagtgtatcccaggggaagccacttcacctctctttgccttctaactctaaatttctgtgattcaacacatgggaaattttcttttgttctgtttggttgaaagagcaaaagtttaccatcactaagtagtttcagtatattactgcaagaacatggtatgggccaggcatggtgactcaagcctgtaatcccagcattttggtaggtggaggtgggtggtttgtttgagcctaggagttcaagaccagcctgggcaacattgtgagaccctgtctctataacatacgaaaactagctgggcatggtggtgcctgtaatcccagctacttgggaggccgaggtgggaggactgcttgagcctgggatgtcgaggctgcagtgagctgtgattgtgccactgcactccagcctgggtgacagagagaccctgtctcaaaaaagaaaaaaaataaaaataaaaagaagcatgttataatctttgcttcacatagaagagactatcttgaaaaagttagttttttctaagttcaaaagttcgttttcagataggtgagatataagagaagtctggtttgggacacaattctctgttaaagaaaatacaagtgagaacctgcatacatctgctctgcatctgcgttttctatttggaggttctggtatactgaaacataatagttaaatattgccgtatttgaccgaatactgaaattcattgaaatcccaaattttattctcaggtagttttttgtttttaactagagataacaatcttctttatgacataccaacactgttacttgtgacttaaagctttggttttcatagcaacctagttggtgtagatctttgaagaacttctttttaaggcaaacttaatgtttcaaaattagttaattgtgtggagatgacttgtgcctttcagaaatagcacccatactgtatattcactctgtacttagtttctgactcactaaacatgtgttccttactcagatttcacctgggtgcaggacaaagagaggcaataagccttttttatttttctgagagatgctgaataaatgaatatttacatgccggagaatactggttttacatacaaacagataaaacacatggtcgcaactgctttctgttctttaaaaaatttgttttgacatatgtcctgctagtaattaatttgtagcctgcaatccttgaaagtagtgtgacctcactgagatgactttgtttactcaaaatggcagcgttttgttggagatttaattgaggtcttctgcattatgcatatttattcagagttgattttagttgaggtattgcttttgtacagattctgtgatagaatgagagaagaattattgccgaatgaaacatagcttcttctcaaaatgagaaaaataagaagtgatacatctgctttaagcagaattttatgcattataaatagtttagattcttactttattctggcaccaatataaaatctttttgccaagagcgtgtctgttgtttcaataagaaaatacatcaaaatcttagtgagaatcacctggaaacgtatacatttattctgtatgcaattttttctttaaactggttttatctccctagcagttgcccattagaatgagattgaagtttgagtccatgcattataagatagattcggtgttctttagattgtgtgaatgttgtcacactttttttttttttttttttttactgcatttgatgtttgtggagattgcatgcttatcccttacattctctgaaattattttagttactgtgaattttagatggagtctaaacaaggtcagcagattacactacctcatccttttagtgttcatttttctcatgatctttgccaaatgagatgtggtcaagcatgctggtgcagtgatattactgcagtaagatgaaagtggggagcaaaatcatagatgctttcatatccaggatgatttgagatgctattggcctgaaaattttatggagagcagcctcatactcttggatgtgaattagaaggactttttatagaggaagaaagcagagtaaagcagattgtttcaaaagaagtgggaattagttaaacttagcagatgtcttttgtccacaaatttcactcagctgtcctttctggagtgcctactgggtcttggggcactacaaggaacatttctgccctgaagcattcactttctggcggggaaacaaacagggaagtagacactttacagtgcagtgtcataagcactgtaatgataagtatatacaagatgcaggtggggttacagacgaagcaatgcttgagtggtgctcagttagcataaaacgattcttaattgttgaaggagtggcagttagaagtagttaaggttataggcagatggaacagcaagagcaaagccataagggtgtgaaagtacatgtgtgtagcttgcttattgaagcagaattggggttttcatgaccatagaagagagtgcaagccaagggagggccttcaagagagcacgaagtggggtgtttgcctggaggagaagttgaacttcttgccctcagctgtttgccagggactggagtggagaatttgggaaaagcccttgaaagagcctgacatgtgtcccctggagtctggaggataacttgctggtatctgactcctgtctgcagaaacctgaaggtgagaagctggttggagctgtcccaatggcaagatgtagccattttaataacaaataactcctggtttcttttcggtagatgctagtaaagagatttgagataggtgagggttattctccccaccctagttttgctgtaagcagtcaacatgccaaacaagtaattcaatctgttcagtaagttcattgaagcccccagtctttaggtgcaaaaatcatcactcttagtagtttattcaaaagtggatatggcagcttttcagacttgttttcccttaatatccatgttaggcagtggggattcccctaaatccagtggctggaaacgggaaccttcagcgatcaagcgtcaaggactgccctccaaagtctccttcccagttctgctgtctgcctactcagtgcctttcccccgaacactcatgttatataagtctccttagtgtttttccagagacactctatcctagatcttctgtattttttgttgctgctttctaacctactttgttttggagatcatttatatcacttcattaagagcactatcttttataatgattgcatagtagtccattgtataaacaaaccattgtttatttaacatttcccagttggtggacattacagacatgctgcagtgagtgatgctgttcctgtgttattttatacatggttgaatgtttgcaggttacataccacaagtagaattacttcgtgaaaagtatcggcatttgtaattttggtagataatgccaaattgctctttagggaagtaccaattgacacttgccaacaatgtaggagccttctgttttcccctgcctcacctatggactagcagtcttaaagacaaaacatgatgtcattgtagttctaattttaattacaagtaagactggacataataacatatatctgagaacagttttatttactttcctgtgaactgatgatttgaaacttcccccaaattcttgtgaggattaaatgaggggatccaggcgaagtgccttctgtaatgcctgtcacacagtacgtgctcaggaaatgttaactaggatgattggtactctggtaactgaaagagctttaacagtgaaggacacctgatatggtttggctctgtgtccccacctaaatctcatcttgaattgtaatccccacgtggcaggggagggacctgatgggaggtgattgcatgggtggtttccctcatgctcttgagactgagagagttctcacaagagctgatggttttaaaagtgtttgcagttccccctttgtgctctctctctccttctgccatgtaagacgtgccttgctttccctttgccttctgccatgattgtaagttgcctgaggctccccagccatgcaaactgtgagccaaacctctttcctttataaattactcagtctcaggtagtatctttatagcagtgtgagaatggactgataaaacacccaagtgtggaatgcagctctgtcccttaccagccatctgctcctgacaagtttacttaatctgagtccaggtttgcccatttgtgctaggaactttgcatagactcttctcgttgatacctttatacctttacagcagttctaaaaggcggctgtgatagcagtatagcctgctaggagattcggaaattaaacctgcttttaggttgttgggttctttaacagggctgcaaccttgatatgtctgcattcagacatgttgatgactaacaattgctgtgtttgaatgagaggccagacaactgttactgcttgtaaagctcttcagctataatgagagtgttatatccagatgtcttattgagagacatctttataatagtaaaaaaattgcaacctgcagttgattttgtattcactggctacttatgtaggaaaaacagcatattggtataaaaagtaaagttaccctaattgatgattgagctgatcaagattcctaatggaagtgtgttgggaaaattccatgattgttcatttttggcttattcttatggagattgcaccagttggatgttttccactgaaaaatgttaccaagcaactatcgccagaacttctgttgcatctttactgtccttaaggctctatatactatttcctgcttatcatgattgtaaaagagaaaaaaaatagtcctagctcataagggagaattttcccccttcttgtatcagtgctgtgtatctgtctctgtgtatgtttgtgtgaaattgttttctttgatttaccttgttctctttcagtttgtccttatagttgggttgttccttatctttccagatagcgtgtaaatcctcttgaaaacagccactgggtttttacctccttgtaggatgcccaggctctagcataatatcttctacacagtgagcactcagtgaatacttgtcgtttttcactgctttaagtttgacttatttttgttcagatgctgcctgacgtcatgatcatttcagaaaggtgagggagctctaagggggcttggagttatgtagggtagtgaatcaggcttttgatatactacattactatgatctttgcatgagacaggtgatgaaataccaaagcgtatatacttttctaagatttcagtcttcttaaaccttgaaaaagtagtttttataagtctggttttattggaaaagcagtaagtgctataattattcatttactttcttcatcttagcacttctactgaaaaggaaaaaaaatgattcaaaatctttccaaacttctaatgtgaaattgtttttcagttaaaatccaatgcaaacatattgaaccctattttaatcctacataattcattttattaactatgaccaaatagaacatctgttaaaattccataatgctagcttcatgggaaaagaaaaaaatccctgtttgctcttggaagttgtccattgttttattattcaggctttcagtaaatgtgtaatgagacattctttttgatggaaatattaaacaaatgaaaatgaaatttcctcttttatcatagaggtttataaaatgagtcacttaattgcatttacattattataactttaccgtagagatgttctatgaagaatgaatgctggttcatttgattcattctttaattcaagaacctaaaattattactcctcaaacctggactttagcctttagtttttcatcatctcttaaataagcaaatatttttaggaagaacaattgagtaaaattatcttaatgtggaagtattactctagcccttcagtgcatagtttctcatgtttcgtttacatgaaaccagctgctatttacttttttcattccttggacaaatttcatttacgctgtgaagtgacttgaaaatgctacatatttccattgttgcatgttggccatgttgtcctgaaggggcaccagttcctgtgtgtatggtttatgggatgtaaatgcaataatatgatgcttcactgtaaacacattggaagctattggatacaggtggaaattatctgttaattctttatttaaacgttgtgaccataaaccatagtgttgaagtagctctttgttgttgttcctttgtggttttcatcccatgtgaaatgtcatctttcttcgtcttcgtgagtccatttggattgcatttaggcttcaaataacagaaaatttgactacaatggtttcaccaaaaaagttttctgtttttcccttttgtaacaagaaatctgaagatgatcattctaaggctggtgtactggttagatgagggcaaggagaatccagtctctttcattttgcctggctaactttaatgctctggctaattgactcatggtcacaaaatggctgttctgctttcaggcatcatagttctattccagaactatgaagaaggggaagggcatgaggcagtactaactttatctgtccttttgtttatctcgaaaacaaaaactttcctgggacagatggtatctcagggcctttatgagttgcgtggggattgggaagttgagtatgtagcttttcactgtagtagatgaagtcaggcaaagggtggactgggggcagtggtactaccgttactgagtcaccccataggatctgccgtattctgtcccttcaaacccttccagctaaagtttcatctcttcagaaagaagaccatttcatacatctctagcttcagcccacatgtgggcatccatcgttgttaagatccatgagtaattgtctgtaccactatttttttttttggtcattctcctctgtaaatggaaatgtctgttcgttttctttttctgccacctttgttcttttgggcactagtgtagaaactcatctttaaaaattatttggtggtctcactgaaattgaagacatgaatttacttctgatttatttacttttatatgtagttttgattttaaagttaaaatctgagaatacttcttatattgatatattcatatgtaaacacctaaaaaatgtgtgtcattttagatggaaataaactgtttacatttaccaagtacttaaaatgttccagtcactgtgctaagttgtttacatacattatttcacataatcctcacagcagcccaaaatgcgatccctacttgacagaaactaaagcttggtaagtttgtggttggcccagggtctcataccagtaagggagagatcagaggactccagaatccatgaacttaacctttatggtgagctgtgtattttacattttataaacagataaattttttctggggaggaaaatatgtatttaaaatgagtaatccatatttatatctgtagtctttaagcctttagataggcgttagtgccaggagtttggggaaactggaagtctacatgatattaaaaataaattaattagaggaaataagcaagtgtaaggaatctgtgttgatggaagtgttcatgaagaactgtggcttgtaagtgcatattatcacgtttgcgtgattttcctttatctaggtgttagtttacatgccccttctctgagggacctcctgtgatcactccagctaaaatagacctaccccatccctgatcactcacctgttacctttgcatgcactgatgtttgaaattaccttcatttcttgttcaaaaattaattactgctgcaaacagggacaatttgacttcctctcttcctatttgaataccctttatttgtttctcttgcctaattgccctggccagaacttccaacactgtgttgaataggagtggtgagagagggcatcgctgtcttgtgccagttttcaaagggagtgcttccagtttttgcccattcagtatgatattggctgtgggtttgtcatagatagctcttattattttgagataagtcccatcaatacctaatttattgagagtttttagcatgaagggtttttgaatcttgtcaaaggccttttctgcatctgttgagataaccatgtggtttttgtctttggttctgtttatatgctggattacatttattgatttgtgtatattggagcagccttgcatcccagggatgaagcccacttgatcatggtggataagctttttggtgtgctgctggattcggtttgccagtattttattgaggatttttgcgtcaatgtgcatcaaggatattggtctaaaattctcttttctggttgtatctctgcctggctttggtatcaggatgatgctggcctcataaaatgagttagggaggattccctttttctattgattggaatagtttcagaaggaatggtaccagttcctccttgtacctctggtagaattcggctgtgaatccatctggtcctggactctttttggttggtaagctattattgccacaatttcagatcctgttattggtcgacatgattgtatatctagaaaaccccattgtctcagcccaaagtctccttaagctgataagcaacttcagcaaagtctcaggatacaaaatcaatgtacaaaaatcacaagcattcttatacaccaataatagacagagagccaaatcatgagtgaactcccattcacaattgcttcaaagagaataaaatacttaggaatctagcttacaagggacgtgaaggacctcttcaaggagaactacaaagcactgctcaatgaaataaaagaggatacaaacgaatggaagaacattccatgctcatggataggaagaatcaatatcgtgaaaatggccatactgcccaaggtaatttttagattcaatgccatccccatcaagctaccaatgactttcttcacagaattggaaaaaactactttaaagttcatatggaaccaaaaaagagcccgcatcgccaagtcagtcctaagccaaaagaacaaagctggaggcatcacactacctgacttcaaactatactacaaggcttcagtaaccaaaacagcatggtactggtaccaaaacagagatatagatcagtggaacagaacagagccctcagaaataaggccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatgggttaaagacttaaacgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattgttgcaacctacttatctgacaaagggctaatatccggaatctacaatgaactcaaacaaatttacaagaaaaaaacaaacaaccccatcaaaaagtaggcaaaggatatgaacagacacttctccagagaagacatttatgcagccaaaagacacatgaaaaaatgctcatcatcactggccatcagataaatgcaaatcaaaaccacaatgagataccatctcacaccagttagaatggcgatcattaaaaagtcaggaaacaacaggtgctggagaggatgtggagaaataggaacacttttacactgttggtggggctgtaaactagttcaaccattgtggaagtcagtgtggcgattcctcagggatctagaactagaaataccatttgacccagccatcccattactaggtatatacccaaaggactataaatcatgctgctataaagacacatgcaaacgtatgtttattgcggcactattcacaatagcaaagacttggaaccaagccaaatgtccaacaatgatagactggattaagaaaatgtggcacatatacaccatggaatactacgcagccataaaaaatgatgagttaatgtcctttgtagggacatggatgaaattggaaatcatcattctcagtaaactatcgcaaggacaaaaaaccaaacacggcatgttctcactcatagatgggaattgaacaatgagaacacatggacacaggaaggggaacatcacactctggggatgttgtggggtggggggcgggaggagggatagcattaggagatacatctaatgctaaatgatgagttaatggttgcagcacaccagcatggcacatgtatacatatgtaactaacctgcacattgtgcacatgtaccctaaaacttaaagtataataatagtaaaaaaaaaaattaattactgctgtcttcccttcactagaatgtatgcatcaggagggcagatgcctcccgttttgttccctactattaatctaacacctagaagagtgtggcacatagcacactcagaaaatatttaacaaaccaatgacttaatcatacttgcttctcaaaagcagaccagttttaagtacttaggtattaagatctccagatacatttagcaagaattatggagttctcactaaattcctaggcaagctaatggttttctgccagataaactgtctgtacttccattgagattaattttcttatcatatttactgctgtctacatatagctcttattttaattttgtcttttctagttacagttactcctgtaactatttcatatattcaaaacagtttttgaagtgacacatgaaaataataaaacttatgaagaagatccttcattaggtgtgtgcgaattatctccagtgaataccgtgtgggtcaagaattacccttgatgttctcattactgtatactgtcttattgtctgaataaacaccatcttatatggagtattaagagactatatatgtaagaaaactaaatttgaaggtcaaatgtagttttttagatgtgtaattaaaaaatagcaattggaatcattcaaaggaaattaaaatgtttatctgtgggttcgactacctggctacagattactttgggatcacataatgaaaatagttaaaatttgaatactaattatgattgttaactttacatatattttcctaatccttaaactgtaagacatcagcctgtttgtacagatcataagcagaggcttagaaaaattaagtaatacaactaggaggtggcaggactggaattggaggtcaagtttgtataattccaaatcctgtgattcttattacactttgcttcctgtttgtgtcttgcagataaattcactgatagaatttttcagtaaatcctaagaaaataatgtgatgggggatctacaagacttgaaccaaatcttgacctgagtgagagtggagcacaatttctgagtgttagaggattctaaaggatagaaatggaactgtttgtatgggcagaacacaatgagatgcttctaaaacagccattaatattgatttcagcatcctttttcgtctggcctttgtgaggggtgcttaaaaatgttttgactgattgtagtctgtccttttttgttccctgtgctgcatcatatgttctgagaaacagtagagtaggtgggaaaaggttgataatctttggccttgaagtggttttggtatacatagccaagtaactagcagataatttattgactagtggagaagcagaaatttttgtgaggatttttttttttccctttttgaatatactctgctttttgttattcaacttgtcagtgcaaaactgacattatagaagaacgcactagagggcgcacaatgcctgtattttaaatgttggtggcaaaaacctcagcatgaacttggaagctgcttcctggcactgtttgaaaaaaaaaaaaaaaggttcaaattagaaaatgtaaatttaagcataatagtgttttccgatcaagatacctgaatggataaatttgtgttatcttttgatacatatgtacatggagttgtatttatttgggttctaattttttaaaacttttaccatggaaaaatttaaagacacacaaaaaagattactaaaatgaatccctgtagtctcatcaattaccagctcttgagcagtattgttccatctataccaaaccctgcttcccacatgtctgtatgatattgaagcaaataccagacattctgatttcatccagaaatacgtcactatgcatctctaaaagataactgtaaatatgtataatgtatcaaaaatgagtgtcataacagaaagacaaatattgtattatatgtgtaaactaagaaagtaaaattcatagaagcagagagtagaaccatggttctcgggtgttagggggtgggtaaatggggagatgttgttcaaagggtacaaattgtcagttataggatcagcaggttctgggtatttaaggtacagcatgaaaagtgatggatgtgttaattaatttgattgtggtaatcattacacattgtgtatcaaatcatcacattgctcactttaatatatataatctttatttgtcatttattttaaaaaacgaatatcatagtctagaagtatttccccaaagctatttatcacttacaaaggggaaaatagtaattttacagttggaaagactggcagtcactattttatccaagtgatcaagattagcatcaccagtaataagattatattaacatcatacatctctaatataatgcaccaagaaggacacaatgtcacttctttggtcttcttgccaaagatgcataatctcagtgtgatcatgagaaaacatcacacaaaccgagattgagagacattgtacagaattgtcaaagttatgataaagaaagatgaaagaactgccacaaataagagaagactaaggagacacaacaagtaaatgcagtgtaggatcctggatttgatcctggaacagaaaagattttgggaaaaactggtaacattcaaaatctgtaatttagctattagcattgcagcaaaactggtagctggttttgataagtgtactgtagttaatttattaacattagagaagccagcatatatgtgaactctgctatttatgcaacttttatgagagtttgtttttaaaaaacaaactaaaatgccacatttggacattgtatgaagtacttgtttttagagtcatcttctaaaataatgacaagttaaatttaaaatttaatttcttttattgttaacttgtattaaaataatatatgcaattagtaacaacccaaataatgtagaaggacttaagatgaaaaacaacagtctcctgcccatccctctccattctggttccactctctagaggtagcctttattttttattttttaaaattttaactgttttatttttagttcttatttcatcggtgctttcagataatatattatttaaatgtctgttttaaaatttgtcagtagataaagtttgttgagtctttgggatggaagatgtgattaagctcacattatgttcttccccaaccctgtctcatcctagcattccagttatataaatttcattcctctgttcattttagaaactttaagttatatattcgtttctttatttcttatcctacgaactttctgcatcttacaactttctcttgacatgatgaggctgttgctttctttttgccaccttgtcctccttaacctgcaaatttcactttctggaaagacttctctcaactatactttcattgtacattgtcaagagggttgacaatttcatcctgtcttttaccctcagtcacttctttcatagctcttctgtattgattctaaaagtggagtaccggtgaactagtgtttgtattattgagaagacttcatgaatgatcagaccatgtagtgtgctaaggctgtatttttttttgtgtgtgggacttacaccctgagagatggtttcagcatcagaatcaaatagaccttcttgcactctatcagttgctaaaatttaatttccaacatttggggcatgagcttgtctttttttcttggagtttctaattgccttttctgtatgaaaaaggcattatttgcattatttttaggtatgacaactttgaaaacatactgtcttttgtcctgagtccccttttaccctgggaatcttggaatctttcattctcctgttctaatcctgtgttaatattcactgtgtttgggcttctattcttgggtcagatttgctgtttcctgaaggccgcatagcatagtggttcagaccagggctttgtggtcaggcagcccaggttttgccaacagctctgcctctgttaaacttacacctggtgctacagtgtcctcattgaatgaaaatgctttcagatatgaaaaatataagaatttagtccatttgtttgaaggcttttatttgattctgatttttttggggaggtggggtcaggtaattatctttctctagtgcctattattttacaaatatctcattaaagacagccgatgataaccattctcatgattctttggcctcaaatgtgtttcactggtttgttttttatagtaggaaggaattatgttaatgttatgattcttagaaaagtattttgatcttattagtttagtgtgtatcctgattatgttttggaaataagtggttaaattgatctgtgggagtcttacaaactgattaccaagtttctgatacagcttgcctgtgtcttgatccacgtattgtaagtctttcctattatcagtgaatttttccatacttctgtttcagagaatggaatgatgactaagttaaaaatcacttcgggacaaaatttattatccttcacagggtaaatgacaaacatgtcatttacctggtagaggataccaatagtatctgtgttcacagtcagctatgctatgtttcatgttgactaacaaagatcttgtgataattagactctgctgatttatctttttgttcacacaatggttttccaaggttttctcatccttttagacatttaatattagtttgaaaaagtagtgagaacaacacatctcaatcattaagttttgatgaagtgaagacaccaaaggtctggtatatagttgcctcttggtaagtgataagttcttaccacattatttttctgtatttgaaggagaaagtaggttgaatttatccagcatctgccatatgccagatgaggtacttttcatatatatttttttcatttaatcttcacagtaattctcaatcattattgccaactgagtaattggaaagtaagtacctcttgaataccttgtcatgattcccagtcaatctgtaatgttcatctaccttgtaaaccattttatatgctaacagacatttctctgtttaataccagtgagaaagctgacctttggtggtgtaacttgatctacataaagcacgaaacactgttagtggaaggcagagttggtctctgaattctttgaactcttaacgctcgtctagtaacagcatatttatttcctttctactctttgaggtatgagtgaggaagtttgaaatgcatagtaacaccacctttttcttttttttctgcctttccagcttttttgaaaaattacaatttatagaaaaggtaaaacgtgtattttttttccccaggattcaccagttaacattttgcttaatctgctctgctcctctttcttcctcttttttttcctgaaatattttaagtaagtagcagacaatttgacacttatcatttagtatttcagcatgtctcctaagaatggagtcctacttctcataactacaatgccattatcacacccaagaaatttaatattcactaactaatattatctaatatgtggtcaatttccctgatgtcccagtgataaaagccttacagcttctttctctactcaggatacaagtgaacaaatacattgcatttggttgtcagggtccccaaccttttttatttcctccatgacatagacttttgtagagtccgagatatttatcctgtaaacggtcccataatctggattatctgagttccttatgattagactcaggttaattggtttttttatatgaatacctaagtattttggggtgtttctcattgagttataccaggaggcacaaaaagtcttacacttggtgagtttaatggtttgattaagttgttttcgtttgttatacactaaaggttcaattatcctttgatgttaagaggcaatctatgcggtaatattttgagaacaagtgattatcccattccccaataaatagttttaacatctgtggatacttcttgtctgaagcatttgttacattggtgattgcaaaataatgattttcctaatactgtcatttttctatgaatttgttagctggcattcttctgtagggaagagtttcctcccttgccctccagatcctttttaaaaaatccccatggactcatggattttaaaaaaatagcctaattgagttagaattcatgtaccagacagtttactcgtttaaagtgacagttcaagggattttactatattcataagtgtgtgcaatcaccaccatagtcatggattctttttttgttcggtaattatagtctattaccattagtattattcttttgatacttaaactgtcccatatttgtccagtggggagcctcttcagcctacttctgtgttcatgtgacatttccccgttagtccttttttttttttttttttgagatggagtgtcattctgttgcccaggctggagtacagtggcatgatctcagctcactgcaacctccgcctcccaggttcaagcgattttcctgcctcagcctcccgagtaactgggattacaggcacgcaccaccacacccaactgattttgcattttttttttttttttttttttttttgagacggagtctcgctctgtcgcccaggccggactgcggactgcagtggcgcaatctcggctcactgcaagctccgcttcccaggttcacgccattctcctgcctcagcctcccgagtagctgggactacaggcgcctgccaccgcgcccggctaattttttgtattttcagtagagacggggtttcaccttgttagccaggatggtctcgatctcctgacctcatgatccacccgcctcggcctcccaaagtgctgggattacaggcgtgagccaccgcgcccggcctgattttgcatttttagtagagttggagtttcaccatgttggctaggctagtctcgaactcccgacctcaagggagtcgcccaccttggcctcccaaagtgctgagattacaggcatgagccactgtgccaggcccccattagtctttgagaacctccttgctggtgtagcaaggtatcttagtcttaccttgtactctccctgccccagtcctgtaatcagcccctccccaagggggccttgattccttctggtggggagtggtatttagaaactataggtgtatcattgcatctaggctcttttattgggcagaaaaaaaaattaaattatttcatctttcccatttcatatatttacatcaggcaagaagaacacagaattatgatttattttaagaattatactgtaaacttctttccggtgttcagtgctgtgaattcagcgtacgtatagatttgtatagccatcatcacaatcaagatacagaacatttccatcaccccaaagtcccttctgctagccgatgcatacccatttccctgcttcctactgctggcaactttagcgatctgttctccatcactatagttttttctgtttgagaatgtcatttaaatggcattacagaatatacagcctttacagattgccttctgtcactcagcgtaatgcctttgagattcatcccagttattgcatgtatcaatagtttcttcctttttattgcagggtggtattccattgttaggacgtatagtggaatacaaaaattatggtttatcctttgatctattgaaggacatttgacttcttttggtatcattattaagagaattcctgttaatagtcatgtataagtttttgtgtgaacatcattttcatttttctagggtagaaatgcaggaatgggtttgctgggccatgtggtgagtgtatatttagctttattagaaactgtgaactcttttcttttctttcttttttcttgagacaaggtctcactgtgttaacccaggctgagtgcagtggcgcagtcttggctcactgcaacctgtttcccgggctcaagtgatcctcctacctcagcttcctgagaagctgggactatagacatgtaccaccatacctggctaatttttgtatttttttgtagagatggggtttcaccacgttgcccaggctggtctcaaactcctgggctcaagcagtctgcctaccttggcatcccaaagtgctggggttattaggccactgtgcctggcccaaactcttttctgtagtggctgtacaattttacatccccaccagcagtatatggttagcacttgattactgtcaggatttttattttagccattttagtaggtgtgtaataataccccataatggttttatttattattgttttaatcttagttgactcttgaatcacaaaagttaaatagtccagaaaataaatttatttgcaaaaaagaaccacacatatttatgagagagaaactttctataagactctaagtttagaatattgagacttctatctcttgaacatggtatctccatttactttaatctccattttctttaatgtttcgataatactttataaatttgttgaccgttttgaattttcttaatttattcctaggtaatattttctgatgccactgaaatgttatctgtgtcttcacttttttatgctaaaatattttaaagtcaattaatattacacacttaaatatttcgggatagactgggcatggtggctcatgcctgttatcccagcactttgggaggctgaggcaagagggtcacttgagcccaggagtttgagactagcctgggcaacatagtgagaccatgttcctacaaaaaatttttaaaaaattgctgcctgtggtggtgcacacccatagtcccatttacttgggaggctgaggtgggagaatcacttgagcccaggaagtggaggctgcaatgagcttagattatgccactgtactccagtctgggcaatagagcaatgttagaaagaatgctgagtgctggaactctaatccattgctatcagagagggaataaagtccttctgaaaaaatagtttcatatgatacagtaaaactgaagatccatataagctgattttctccaccactggcaggtgtatacctaacagaaatgcacatgtgcaccaagagacacatgcaacaatatgcatatcaatattgtttataacaggaacaatttgagataaatgtttctcaatatgagaaaaaataaactatgatatgtaagtgcatggaataatacacagtagtgtaaaaagaacaaactgcagctcttgcaacaacatggatcaatctcaacaaatttcataacaagagatgcaaagtcatatagggtaagtgctcatacacagttcagaagcagtgcttgccacattttcaaatggtgcagcaaatatatatttatatccatctattgagatatcaagaaaacacggcgaaaggttaataatatttgggaatctgggtgaagaatatgcaaaaattcattgagctattttgttaccattttgtaggtttgagatttttcaacataaaaggataggaaagagttaaaaatcagattaaagctaatttatatggttttggagtacaaacatgggtagtaaaatgataagaaaataccacaattaaggatagtaccaactctgggaagaaggatgaacttttgctgaggaagagcctagtaggggtcttctggtgctggtcatttctttacctgagtaaatgtgtgagctttcctttataattatctattaaacaatccatatgaattatatgcatttttcatatacatatttcacaggagaagaaaggtaaaaacagtgtaatgaggtatataaaaatactttcaaagaaagattgctatccacttgttaaacattattattattttttttaaaaaaccctgcatttgctttgtaacaagcgaagtaaggggatttttgctatgtgagttgtttacctgagataaatttatcaaaggcacttactgaggaccaatttttgaggctaccaatataatgtcatcttacttttacataaggtagttcttatacagctatcaattctgaatcttgtttagtttggtaatactaggtaataaattcttttaaataatcccaggctggagtgcagtggtgtagtcatggctcactgcaacctctgcctcccgggttcaagtggttctccagcgtcagcctcctgagtagctgggactacaggcacccaccagcactcctggctaatttttgtatttttaaatgagatggggttttaccctgttagcaaggctgatctccaactcctgacctcaagtgatctacctgccttggcctcccaaagtgctgggattacaggcatgagccaccacgcctggcccaaaacttgttatatttgaagccagatgtattctggtgtttctgaggcctggaacgaaccacattgcccttctgggagctaaccacagaaacaagcaccctgcccttactagaggggaaataatgcagggaagaccaacaaactactcccaggagttgatgctgtttctcatagtggttttaattttcagttccctaatggctaatgatgttgaacatcttttcatatgcttatttggcatccttgcatctttttatcgtgaagtatctgttcagtctttttctcatttttaattgtacggtttctttgggagtttcgaaagttctttatatatttggaatgctcatcctttgcccttaggtgatttgcagtattttctaataatctgtaacttgtaatttctctaaacagtattatttgcaaagttaaagttttaaattttggtaaagttcagttcattttttcttttatgaattgtactttggatgtcatctctaggaactctgcctaactctaagtcattaaggttttctcccatgttttcttctaaaagttttatagctctatgttttacatttacatctataatccattttgagttgatttttatttaaggggtgaggtttagctcaaagtttgttttttgcatatatagatgtctagttattctaacagcatttgttgaaaagattttttttttcctcactgaaatgcttttgcatcttttaaaaaaatcagttggccagatttgtatgggtctgtagctggaagaaatatatatattaaggaatctgtatatataggttccaagcaatgtctttatttttctttatttaggtgtttgttttcatatttttgaatatcccagtcttgaaagatgatgttttgattttctgagacctttcccttcgttttttaatttaattttctttttctcgagacaagggtgttgctctgccaccaaggctggggtgcagtggcgtgatctcagctcactgcagcctcccttctggattcaaatgccacctgagtagctgggattacaggtgtgcaccaccatgccctgctaatttttgtatttttaatagaggcggggtctcaccatgttggccagtctggtgttgaacccctggcctcatgtgatctgcccaacacagcctcctgaagtgctgggattacaggcatgagccaccgtgcctggcctgtttgttttttttaattgatatgatggctatcttaaaaaagtctcaaagcaggctgggtgcggtggctcacgcctgcaatcccagtgctttgagaggctgaggtgggcagatcacgaggtcaggagattgagaccatcctggctaacacggagaaaccccatctctactaaaaatacaaaaaattagccaggcgtggtggcaggcgcctgtagtcccagctactcaggaggctgaggcaggagaatagcgtgaacctgggaggcggagcttgcagttagcccagatcacgccattgcactctagcctgggcgacagagcgagactccgtctcaaaaaaaaaaaaaaaaaatctcaaactgttttctgtcttttctctcctaaaacatctctttgttcctttttcttttttaagtgatagaaaggactgactttttagtcactgtttttacagttcaataattcggtatctttcactttttttctgtctctatttttctgaacatgcctattttctcttgcattactatactgttaatatgtagacagtggattagaagctcagttcttcctcttttttgattcataatatagttactattacttccttatatagattgtgccattagtttttaaaattcttgctgttgcattatcatgtagtaaaaataatttcaacattcacctacgggaatgaggaaaaggtgctgtgtattttgttttatccaagcacgaaggatctttgctttgagttgtcttccttacaatatcctataaaatacataatctgaagtgagttgctaagattactgtttactttgtgctgaaataaacctagaacctaaattatttgcttcttattgtagcactgccttcttagaattgaaactctaaaaatcatggaattaatgtgaagtttttaatgcagaggacagattatagaaattttctttgtacactatcactcaaacgtttgctgtagttttgagaataatattgttactgaagtggtgacccagtaatttttagttcaccagaaaacatttatagagtaagtgtagggtacagaggtgtagaattagccatgtgtggatgggacagaggagagagattctgcccctagacagcttctcctatttgtgtgtggaaattcatggatatttgtaaagcagttcattagtagttgaacactcagtaattggatattttaaagtgttggagtactgacaagataagaacaaatagacagtgaaggagtgaatccctgtctctgaatgagttgaattctgggcagtccttttagacaacttagaaaaaggaagggtagagtaaaggaattgatatgttgacattggaaagcattttttttaaaaaaattaaactttaagttctgggatacatgtgcagaatgtgcaggtttgttacataggtatacatgtgccatggtggtttgctgcaaccatcaacccgtcttatacattaagtatttatcctgatgctatccctcctgtagccatcccctacccctcgacaggccccagtgtgtgatgttcccctccctgtgtcaatgtgttctcattgttcaactcccacttatgagtgggaacatgcagtgtttggttttctgttcctgtgttactttgctgagaatgatgggttccaacttcatccatgtccctgcaaaggacatgaactcatccatttttatggctgcatagtattcaatgatgtatatgtgccacattttctttatccagtctatcattgatgggcatttaggttggttccaagtctttgctgttgtgaatagtgccgcaataaacatacttgtgcatgtgtctttatagtagaatgatatataatctgttgggtatatacccagtaatgagattgctgggtcaaatggtatttctggttctagatccttgaggaattgccacactgtcttccacaatggttgaactaatttacactcccaccaacagtgtaaaagcattcctatttctccacatcctctccagcatctgttgtttcctgactttttaatgattgtcattctatctggcatgagatggtatctcattgtggttttaatttgcatttctctaatgcccattgatgatgagcattttttcatatgtttgttggccacataaatgtctttttttgagaagtgtctgttcatatcctttgcccagtttttgatggggttgtttgtttttttcttgtaaatttaagttccttgtagattctggatattagccctttgtcagagggatagattacaaaaattttctcctattctgtaggttgcctattcactctgatgatagtttcttttgctgtgcagaagctctttagtttaattagatcccctttgtcaattttggctttgttgccattgcttttggtgttttagtcatgaagtctttgcccatgcctgtgtcctgaatggtattgcctaggttttcttctatggtttttatggttttaggtctaacgtttaagtctttaacccatcttgagttaatttttgtataaagagtaaagaaggggtccattttgagttttctgcttatggctagccagttttcccaacaccatttactaagtagggaatccttcccccattgcttttttcaggtttgtcaaagatcagatggttgtagatgtgtggcgttatttctgaggcctctgttctgtcccttgggtttgtatatgtgttttggtaccagtaccatgctgttttggtttactgtgccttgtagtatagtttgaagtcaggtagcgtgatgcctccagctttgttcttttgcttaggattgactaggctatgcaggctcttttttgattacgtatgaaatttaaagtagttttttctaattctgtgaagaaagtcaatggtagcttgatgggaataacattgaatctataaattactttgagcagtatggccattttcacgttaatgattcttcttatccatgagcatggaatgtttttccatttatttgtgtggtctcttatttccttgagcagtggtttgtagttctccttgaagaggtccttcacatctgttgtaagttgtagtcctaggtattttatttcctttatagcaattgtgaatgggaattcactcattatttggctgtttatctattattggtgtatggaaatgcttgtgatttttgcacattggttttgtatcctgagattttgctgaagttgcttatcagcttaaggagattttgggcagagtcgatggggttttccaaatgtacaattatgtcatctgcaaacagagacaatttgacttcctctcttcctatttgaataccgtttatttgtttctcttgcctgattgccctggccagaacttccaatactctgttgaataggagtggtgagagagggcatctttgtcttatgtcagttttcaaagggaatgcttccagcttttggtcattcaatatgatacaggctgtggttttgtcataaacagctcataatattttgagatacgtcccatcaatgcctggtttattgagagtttttagcatgaagagatgttgaattttattgaaggccttttctgcatcatttgagataatcatgtggtttttgtcatggttctgtttatgtaatggattacatttgttgatttgcatatgttgaaccagccttgtatcccagggatgaagctgacttgatcatggtggataagcttgtcggtgtgctgctggattcggtttgccagtatattattgaggattttcacattcatgttcatcggggttattggcctgaaattttctttttttgttgtgtctctgccaggttttggtatcaggatgatgttggcctcataaaatgaattacggaggagcccctctttttctattgtttggaatagtttcagaaggaatggtaccagctcctctttgtacctctggtagaattcggctgtgaatccgtctggtactgggccttttttggtttgtaggctattaattacttcctcaatttcagagcctgttattggtctattcagagattcaccttcttcctggtttagtcttgggagggtgtatgggtccaggaatttatccatttcctctacattttcttgtttatttgcatagaggtgtttatagtattctctgatagtagtttgtatttctgtgggttcagtggtgatatcccctttatcactttttattgtgtctgtttgattcttctctcttttcttctttatttgtctggctagtggtctattttgttaaccttttcaaaacatcagctcctaaattaattgtgtttttggggggtttttttgtgtctctttctccttcatttctgctcgtagttatttcttgtcttctgctagcgtttgaatttgtttgctcttctctagttcttttaattgtgatgttagcatgtctattttagatctttcctgctttctcctgttggcatttagtgctataaatatgcgtctaaaacactgctttagctgtgtcccagagattccggtacgttgtgtatttgctttcatcagtttcaaagaacttatttatttctcccttaatttcgttttgtaaccagtagtcattcaggagcaggttgttcagtttccatgtagttgtgcggttttgaatgagtttcttaatcctgagttctaatttgattgcactgtgatctgagagactatgatgatttccatttttttacatttgctgaggagtgttttacttccaattatgtggtcaattttagaataagtgcgatgtgttgctcagaagaatgtatattcttttgatttggggtggagagttctgtagatgtctattaggtccccttggtccagagctgagttcaagtcctgaatatccttgttaattttctgtcttgttgatctgtctaatattgacagttggtgttaaagtctcccactgttgttgtgtgggcatctaagtctgtttgtaggtctctaagaacttgctttatgaatctgggtgctcctgtattgggtgcatatgtatttaggatagttagctcttcttgttgcgttgatccctttaccgctacataatgcccttctttgtctttttttatgtttgttggtttaaagtctgtttcgtcagagactaggattgcaaccgctgattttttttggtttccatttgcttggtaaatattcctccatccttttattttgagcctatttgtgtctttgcacatgagatgggcctcctgaatacagcacactgatgggtcttcactctttatccagtgtgccattctgtgtcttttagttggggtcatttagcctgtttacatttaagattaatattgttatgtgtgaatgtgatcctgttgttacgatgctaggcaaaataacctattaattgatgcagtttcttcgtagtgttgacggtctttacaatttggtatgtttttgcagtggctggtaccagttgttcctttccatatttagtgcttccttcaggagctcccataagccaggcctggtggtgacaaagtctctcagcatttgcttgtccataaaggattttatttctcctttgcttatgaagcttagttcggctggatttgaaattctgggttgaaaattcttttaagaatgttgaatattggcctccactctcctctggcttgtagggtttctgcagagagacctgctgttagtctgatggcttccctttgtgggtaacccgacctttctctctggctgcccttaacattttttccttcatttcaacctttgtgaatcttgacgattatgttgctctttctcgaggagtatcttagtggtgttctctgaatttcctgaatttgaatgttagcctctcttgctaggttggggaagttctcctggataatatcctgcagagtattttccaactttgttccattctccccgtcactttgaggtgtgccaatcaaacgtaggtttggtcttttcacatagtcctatatttcttggaggctttgtttgttccttttcattctttttttctctaatcttgtcttcacattttatttcattaagttgatcttcagtctctgatatcctttcttctgcttgatctatttggctattaatacttgtgtatactttatgaagttctaaaaatgtggaaagcttcacgaatttgcatgtcatccttgcacagggcccatgctaatcttctctgtattgttccaattttagtgtatgtgctgctggagccaacgcggaaagcgttatttttaaaaagtgtgcttaactgcctttaaggagtattttttacttgtactttgaatggtactaaaacattgagcctgggctttcttcatgaaatcatatacaccaaacacccctttggggttgggatttttgttaattctttttttttaaaatttaaatttactttaggttcaggggtacatgtactggtttgttatgtagggagacttgtgtcatggaggtttgttgtacagattattttgccacccaggtactaagtcttgtgcccattagttttttttttttttcctgatcctctccctcctcccagcctccaccgtccgataggctgcagtgtctcttattcccctccgtggatctatgtgttctcatcatttagctcgcaattataaatgagaacatgtggtatttggttttctctttctgcattagtttgcaaaggataatggcctctagcatcatccatattcctgcaaaggaagtgatgtcgttttttcttacggctgtatagtattcatggtatatatgtaccacatttcctttatccagtgttttattacgggcatttaggttgattccatgtctttgctgttgtgaatagtgctgcagtgaacatacgtgtgcatgtgtctttatgatagaaggattaatattcctttgggtatatactcagtaatggagttgtagccctgtaatagagcttgaagtctggtagtgtgaggcctttaagtttgttctttttgcttaggattaccttggctacctgggctctttttttttgttccatatgaattttaaaatagtttttttctagttccgtgaagaatgtcagtggtagtttaataggcatagggttgaatctattatataaattgctttgggcagtatggccgttttcacaatattgattcttcctactcataagcatggagtgttttttcatttgcttgtgtcatctctgatacctctgagcagtgttttctagttctccttgtagtatctttcacctccttggttagctggatttctaggtattttgttctttttgtggcagttgtgaatgggagttcattcctgataggtctcttggcttgccggtgtataggaatgctagtgatttttgtacgttgattttgtatcctgagactctgctgaagttgtttatcagcataaggagcttttgggccgggactatggggttttctagatatatgatcatgtcatttactgagtttttaacatgaagtggtgttgaattttattgaaagccttttctgtgtctattgagataatcatgtagtatttgtttatttatttatttcatgcataactcctcaagttagagggagaaaataaaattgcgagtcaaggtggaatttgtttggaaggctctgtgtgatgttctcatataaattatagaaatgagtagtcttagaatatcagcattaaatagaacttttaaaaaaattcatgtagcagtaggacaaaagaaaaaggtgtaattagctagttaacactctgtctactatgtagtaacctatttactatgggtcatttactgattaccacacgtaattgttaggaaagtctttgtagcaaaaatgaccatgatgctccagtttgtggacagtaaagaatccactttgcttttggctcttagttgtaggattacatttaaaagatctcaaatgaatttactctcattgcaattaaaaaatataaactgttaacttcttatcaaaaacactttactgctgttctttatattaaaataaagttagacgtatgctgaatctcataaaaactggttggatacagaataaaaaaagttgatttatctcatgcaaatcaaaaaccccaaaacagtttacaacctattttgtaactcagaggatgttaaacaggcatcactcatgttttgaggcatcttgaggcattattcagtatatatgattttgccaacttggatggcctttgcattttctcaaatttgcttgtgtgttttttttgagacggagtcccgcacttttggctgggctggagtgcagtggcgcgatctcagctcactgcaagctctgcctcccgggttcaagcaattctcctgcctcagcctcctgagtagctgggattacaggcgcatgccaccatacctgtctaattttttgtatttttgttttttttttttttttgagatggagtctcgctctgttgcccaggctggagagcagtggtacgatcggcttactgcaagctccgcctcccgggttcacgccattcttctgcctcagcctcctgagtagctgggactacaggtgcccaccaccaagcccagctaattttttgtgtgtttagtagagacggggtttcaccatgttagctagaatgctcttgatctcctgacttcgtgatccgcccacctcggcctcccgaagattttttgtatttttaatagagacgaggtttcaccatgctggccaggctgatcttgaactcctgacctcgtgatccgcctgccttggcctcccaaagtgctgggattacaggtgcaagccaccgtgcccggccatgtgtgtgtttttaaaactattttttaaattccatttcttgtctgggcacggtggctcacgcctgtaatcccagctttgggaagccgagatgggtggatcacgaggtcaggagttcgagaccagcctgaccaacatggtgaaacctcatctttaataaaaatacaaaaattagctgggcatggtggcaggcacctgtaatcccagctactcaggaggctgaggcaggagaatagcttgaacccgggaggcggaggttgcaatgagccgtgatcgcaccattgcactgcagcctgggtggcagagcaagactccgtcttggaaaataaaaaaaaaatttcttaaagaattggagccatcaaagttggcaagcattaagcatgctaattagttcaacatactgaccaattctctgaattattagttcaaagaagcatgtggacagggatgaaattaaatttgggaatttttcactctagttgttttaggatactcaggtttgctttgatctgtaaataacagatgcttttccatgcatggtttagagtacatcaaacatgttcaaaactttatctcagatacttaaaatcaagttattttattttcctgatatacatgcatttgctttatttttaaaaataaactgtcataaaatagttgtaaggccatacataaaatttactttattaattgctaaaatatattgcttatttaaataatcagttttaagagtaaaagctttggcaactatgaaagcatagggagtatgtgttcatatgtgaatgtattgtgtgtgtatgcatagtatacttttaggtatctaagtagtgaagataaatgtctgctttacttttattagctaaatattatatttaacttaataattatttaatcactagaatgaaaataaaactttgaacagaagcattgtttttaacttaagtttcatagtttactacctcttttggctcttaaccataattttagtactgggaagaatttttttaacgaatggcataaaatggattgcagatgggatgagaaaggtgcaggaccaagagggtaagaactgagaagtcctcgattctgttttccacactccctgaacagaaggcttgactggcgtaggccctgctccaacctagtgtaggctgcaggaagccatgtgacaagagtccagattgttgtccaatggtggaagcctcccatttataagtaataataagaataagaatgtttggcattgagcgaggtgcggtggctcacgcctgtaatcccagcactttgggaggctgaggcgggtggatcacctgaggtcagaagttcaaaaccagccaggccaacatgatgaaacccctatctctattaaaaatacaaaaaaaatagctgggcatggttgtgggtgcctgtaatcccagctattcgggaggctgaggcaggagaattgcttgaatccgggaggtggaggttgcagtgagccaagatcgtgccattgccctccagcctggtcaacaacagtgaaactccatctcaaaaaaaaaaaaaaaaaaaagaatgtctggcattaattctagaactgagatgctcttttgcttagtaaagtcattttttctttttgatcattaagctacatgaggttttgtaatgcattccatttgtggctgttctttatcaaaatattactataacagtagcttccttagtacatcagacatcaggacactgaaggtctagttgcagttttgccactcgctatcttgtgccttttgaagttgtttaatctctctgggtattgatttccttttttaaaaaatagttggtaaactatgacctgtgggcctaatccagatcacagcctgtttttgtaataaagctttattggcatgcagccactttctttcatttatgtattgtctgtctgctttcacacaacagtggcagagttgagtagttgtaacagagactgtatggaccataaagcctaagctatttattatctgactctttacagaaaaagttttctgaatcctagactagatcatctttgagggctgtgctgtgccttagattagatttcctttttgtcaatttctctttaattctaagttctcaaaagatgtctgtctttaaaggatatagcatatcatttcctcgttatcaaatttgcaaattatgaaaagaaggaaaatactgagtagatcattggttcccaaagtacagtccctccacgaatagcagctgcattccctaggaacttgctagaaatgcagaatctaagtccccacttgagatcttctgaatcagaaacttggggtgaggcccagaatttgtgttatacaccctctgcatgattctgatgcattctgaagtgtgagaaccactggactaggtgatacaaagttcagttaacagattttcttctgttttgaaaaaaagaagagcttaaataccaaaaccatttgataggtatatcaggaggaaaatgaaatgttggatattattactaagctggtgaaattaatattttctctagtaaaactccttgtcataaattgtggataagttttaatataatgagaaatttctgagaggtacatctgtgtcactttcagcatatttttaatggacagaaaagtaaatatgatttatttctttgtggggttttctttttttggtgggagatcactttgaattatttcaaaactgatgatttgtaataaacagttttcagaataaaagaattacattaagaattaatttgcttgtgaagaaagtgtcttaagaaaagagcatttaaggggcacagcagcctctgctgtagctggatttcttacccattttaagtgacatcagtgttgaattgactttttcctcagtgctaaaagctgctagaaatgagcaccagtcacactactgatctgtgttaggaaagatcacaaacacagtactttgtaataaatgtcagaggaatagcaaaattgtacatgtcaagaaagcattacaggatgacgttgctatttggagaattgctttcatctttgagatatctcacacctgcttcatttggcataggttgtttctatttcatgaaaaacagtcttttccctcccccagatcccaagttacatagaaacagtatgctaacaagggaaaaattttaacataaaaactcacttgaaggtgccatctaaaaactcagtgtgtaaacttagttaactaactttattttgttgaaaagggacccttggtttgtgtgtgtgtatgtgtgtgtacacatgaatacgtacctatgtatacatttgttactgtgtgtgtgtttatatatgtatgtatacagttcatttgatgtgcgtgtatatgcacccatttccatgtatgtatttaaaagaatacatacaacaaactttttttttgaggcaaagtttccctctgtcacccaggctggagtgcagtggcacagtctcgactcactgcaacctccgcctcctgggttccaagcgattctcatgtctcagcctcccgagtagctgggactacagatgtgtgccaccatgcctggctaatttttgtgttagtagagactgggttttgctgtgttggccaggctggtcttgaagtcctggcctcaagtgatctgctcacctcagcctccgaaaatgctgggattataagtgtgagccgatgtgcttggcaaacaaacttttgtatatataatcctttcatactaatatttaactacttgtaaaaactatgttaacccccagtcactaacacagttccgtagtccatatttattattgcttctttcacttttctcctttcttcatgcatgaaaatataatgtgatccaagggggtatgtgtgcatgaggtgtgtgtttatagagtaacagttaaatgtctcgaaataaactgatttggatttttaggttatagatgtttttgttttttattaaacgtcttgattgtttgactgtcatggttgtttgtataactccttgagaaacttccacatgcgggtagtttttgaaaaagaaaatatttatttgcttcagtttttcaggggatggtatcatactgctttttcacattttatgggtgacatatttggctatctctgggcaaaaatccagttaaaaataatagtatttaatatttaataaactaccaggcttttgagccatctggaactttattttctttgcacgcagcatctgagtttcagctgttagcgtttctcctttgctctgggaagggtcaattgcttttaaagtctttgaagcttgctgtgtcagcccttttcatattttcaaaatgcccgtgtaaaagggtttttcatccattcatgctgataagtcttttgaacttgaggtttgaaccaagctaatcaaatttaattatagcttaaatcccgttacagtgaactccagtggacttctaggctagggtttttttgttttgtttttttttttttttttggtgttatactggaatttagccattaccaatattacttgaagtgagcaggccattgactgcagtttgggagaccttttgtaatggtcagattttagttatagtgacattggcaatatgatttgaactttattcttttccaaaggaaataattgaattagccacaagtaaaatttcttgttctttgcatatatttcaaattaccttttcctatttgtcttaaacaattttgaacaattaaaatcttaaaagtactttcttaaagagtcctttggtggtggtgtcgctgatgctcgttttttgtttttaagatccataacagaataaggatttatatacatcctcctagggataatgtcatggtttctgcatatttgcatagcattttgagagagactttttcctttttgcttcatgaaaaaaagtttgagcagtataattttctagaaagaaggaaatataaatattttagactgtagcatatactaaagggaggtggactagtactgatatttttagtgctttcttcaaaatgattgctaacacgtgtattatattttagtatcttgttgcattcacttgttaatctgtatttatgcttctgtatatgcagagttttttgttttttccaacacaatttaaaattctacttaaaaattacttgtttggatttctaagcagatttgggaattacggcattgaaaatactttgttgctttttatgtctcaataaagtctatgcatttttataatattggaccagtgtttgacctgccagaataaaatgatgatagaactcattgtgtcctcaaataattggattctgaaatggaagatagggttcatgaagaataaaaaatagtagatctcatgtaaaggtgaaaatttacttttctttttagtattcaactcaaaattgccagtttccctgaatttattatagcaatttctcttgttttaaaatgaagtgaaatgtgaagttaatttacatactagctgctttgaagtgtaattttgcttgccaagttgttacagatttttatacagactttttaaggaatttagtaataatgctgccacagtgtgtaggacaagttcatgccttgcatctttgatgggcgttagaattgtttgccacagttcccactctggttggagggcacaaccaattcgtctatgccttttgacttccatgccggagagtgtgacttctgcatctgtttgttagtatttttatgtaagcagaagccaagaatgtcattagaaagtaaaactttaacaagagggactgaatcctactaggccaacataatttatagagagcaggggctaacattttcatttgggaaaaatgcttccatttctatacgtgtttagacggagtaccttaagcattgttttagtcttttcctatctacatgttaccattcagaacttaggtggatgaaacacattttatatgtagttacagagagatacagaattaaaagcctacagatacaagcattagaattgtgacgggggtaattagaaacatggagtctgaaggtagcctatctggattcaaatcccagctccagtacttagccatgtggccttaggcaagttatttaaactgacttattttgttcctctgtaagatgagagtaacaataataccaacctcataaggttgttgggaaaattacatgtgttcctgcatatgaagtgcttaggacagtgcctgaaatacagtcctatataaatgttataatttatgattattgttgtgatgataatgatgataatatcactagcagctcctctgaaacttgttggcctcatccaaggcctatcacttagctttatccccagtgtctctaatactccatctgttgtgcagaagtatatcctgaaccttcctccctctgaatttgcccacttggcacctcttcatttgctcttacaatctctagaccataaatttcaaagacgtggcccaaaatgttggactcaaggtttttgcaaactacaagctaacatgttaaaattgagtggtttcatatacaactccagttatccaagttttcttggacaatctgggtatctggtcatagtgggcctacatttctgcatggcagtaattgtctagaacagagtagcggctgcttgttttgacagaaactgctctccatgtcatcagagtccctgccacttcctgttgttttgacacttttctcattctagtcatcgatatcatttttttgggtcatgtaatacttatttgctgccagcagtttagagtaagcagcggttctccaccatgtgttctgcacactcatactccactaggcctttgctgataggtcaccagattttgattcatgtgtaaaacatacattagttaaaatcaagtatgcataatagtgttttggctttgtctgtcagaagcaacattgagctgggcaggtgtgcttgtgtattagagctagatacaacttggtgaaaaggttagcccatatttaagttcaaaccaaagaacagtgattaaagcccaagccaaagaaaattgagatatgggagagctttgccttctgagtgtgtaagggagcacaggtggtgcacgccatgtgttcagtgtctcagtgctagggagtcagcagggataaagaaagataactgatgccttagagcagagtttaaggggctgtggattgtgtccatggggacccccctttgcattccaggctgtgtagcagcatccctggcctctacccactagataccaggagcacctcccgtgagtagtgacaatttaaatgtcccctgggaggttgaaagatgcagaagacattataatatagtagttatcatggtctagtcactgttgacatctttaatactgcttttagtctttgaatcctttgaaatattggctttgtactccacttttctaaagcattcagtatttattttatggccattttactacagtatcagagaggagatatacttctctccccctctctagtcaagcacaactgcaagtatctttaaggcgcagccacctttaaggaaagacttctgggaacagctaactgtgttggaggaactgggctgtggctcgtcctctgctgctcgttagccctgtgaacctggggaggctagctccctctcttagtcttggctaaaagtgaggtggctggatcagataatcagcaagatgccttccaggtaagattaggctgtaagtcagaaaatattgtaggacttctgaaactttaactgccagtcaagatcacttaactagaatgtcccacatttttcactccattgaaatgagtaacttcaagtgtcatgtaacatcaggatcacttaggggaatgtctagaggtgcagtagatgattgttagctttctgttgctgtgtaatgaattaccacaactttagtggtttaaggtgacatatattgatgatctcatgggtctctacagcagcagtctgaggaccgcgtggctgagttctccattcactgtttcacacagtgacagtcaaggtgttgcagggactgtgatctcatctgaggctagggtcctcttccaaatgcacagggcggttggcagatggcatttccttgtggcagtatgactgaggatcctgtttcttgttagcgattggatggtgaccacactttacttccagaggctgctctgaggtccttgccatgtggccccctccataggcccttttacaacatgaaattttatttcttcagagccagcaggagaatctctcacacttcagatcttgttaggaaggggctggtttttctaagaactcacctttgaagtcaagcccatccacgataatttccctcttgataaactcagaaccaactgatgggggaacttaattaaatctgcagaatccattcatatttctgattaaatgtaacttcgtcacaggacttgtctttgtcctgttcacggtcccatccacactggatgggggaggattatacagggcgggtacatcagggagtgggaatcttgggggcctcccacaatgcctcttgatttaaaaagattctggagcatactttttcttatgtctcatatctaagctaatatcttcccttttctgttcagtttcagttttgtgttcacatgtctgttgtcatattttttcttctatttttgcaggaggaggattagagtcaaaggtgtggggaggcttgtgagcttctgtgagttgttgtgtgtggcttgtatacatgctgttatactggtaagctctgtaacaacccctgattgctgaacatgctaactgggatatacgctacatggttcactggtgctttcaggaaaccatcgaggtgtcaggcattgaggattcgttgttcactaatacattctttaaaatgcttttagaatcattatatccagtttcctttctctctgtacatgggactgattaaccaccatgtgggtggaaatctaatttgttgctggctcagaactttgcaattttcaatactttgcagaattatcctgtttaccaaatgaattgtgataaaaattgatacattagtattaagaggatgacttataacatgtactatgatttatagggccaaaaagacctgataaactcacaaccattttaccccataatgttaagaaactcaaaagattttgtcaccaaaaagtgtatcttgtgatttattttttatgacacggtagtatcacttgttagagttctgagattctttattagcaactgacagttttctaggaactgaatttttacacttagagctgcgaaaagccaaaagcatttctaaatgatctccatcccattcccctcaaataataatgtacacgctcattatagtttgttagtttctcatgcctttctttggtgttctcatggttgtgagaagttgggagaagcagcgtctaaatttaggaaatggatttcttttctgttactaagtacattgctataatttaaagacaacaggagaacatgtcttttatctcaaatgggtctgctatttttcttctaaggtgtttctctaagagtaacattatgtaatttaatcagtgttataaaaaatggaattcctggttaggattttaaaaggtgatgttaacagatatcaaattttttatattagggattgaaggacttttatttatttatttcattttaatttttaagctccaggatacatatgtaggatatgcagctttgttacataggtaaatatgtgctatggtggtttgctgcacctgtcaacccatcaccttggtattaagcccagcatgcattagccatctttcctaatgctccccttccccccaccccaccctgtgaaaggccccagagtgtgttgtttccctccctgtgtccatgtgttctcattgttcacttacaagtgagagcatgtggtatttggtttgggttgattccttgtctttgctattgtgaatagtgctgcagtgaacatacatgtgcgtgtgtctttgtaatataatgatttatattcctttgagcatataccctgtaatgggattgctgggtcaaatggtatttctggttcttgctctttgaggaattgccaccccatcttccacaatggttgaactaatttacattttcaccaatagcgtaaaagcattcctgtctttcctcaacctcgccagcatctattgtttctttctttttttctttttcttttcttttttttgagatggagtctcgctctgttgcctaggctggagtgcagtggcactaacatgactcactttaacctctgcctgccaatttcaagcagttctcctgcgtcagcctcccgagtagctgggactacaggtgtgcaccaccatgcccagctaattttttgtttagtagaaacaaggtttcaccatgctggccaggctggtttcaaactcctgacctcgtgattcacccaccttggcctcccaaagtgctaggattacaggcgtaagccactgcgcctggtctgtttcttaactttgtaataattgccattgtgaatggcgtgagacggtatctcattgtggttttgattttcatttctctaatcagtgatgttgagcttttttttcttatgtttgttggctgcatgaatgtcttcttttgagaagtgtcttttcatgtcctttgcccactttttaatagggttgtttttctttttcttgtctctctcttttttcttttcttttttaatactttaagttctggggatacatgtgcacaacgtgcaggtttgttacataggtatacatgtgccatggtggtttgctgcacccatcaacctgtcatctagattttaagccccacatgcgttaggtatttctcctaatgctatccatccccttgcccccagcccccaacaggccccagtgtgagatgttcccctccctgggtccatgtgttctcattgttcacctcccacttatgagcaagaacatatggtgtttggttttctgttcctgtgttagtttgctgggaatgatggtttttagcttcatccatgtccctgcaaaggacatgaactcatacttttttatggttgcatagtattccatggtgtgtatgtgccacattttctttatccagtctatcattgatgggcatttgggttggttccaagtctttggtattgtaaatagtgctgcagtaaacatatgtgtgtgtgtgcctttatagtagaatgatttgtaatcctttgggtatatacccagtaatgggattggtgggtcaaatgctatttctggttctagttccttgaggaattgctgcactgtcttccataatggttaaactaatttacactcccaccaacagtgtgaaggtgtctgtttctccacatcctctccagcatctgttgtttcctgactctttaatgatcgtcattgtaactggagtgagatggtatctcattgtggttttgatttgcgtttctctaatgagcagtgatgatgagctttttttcatttgtttgttggccgcataaatgtcttcttttgagaagtgtctgttaatatcctttgcccactttctgatggggtcgtttgttttttcttgtaaatttatttaagttccttgtagattctggatattaaccctttgtcagatggatagattgcaaaattttctcccattctgtaggttgcctgttcactctgatgatagtttcttttgctgtgcagaagctctttagtttaattagatcccatttgtcaattttggctgttgttgccgttgcttttggtgttttaatcatgaagtctttgcccatgcctacgtcctgaatggtattacctaggttttcttctatggtttttatggttttaggtcttacgtttaagtcttacatcttgagttaatttttgtattaggtataaggaaggggtccagtttgagttttctgcatatggctagccagttttcccaacaccatttattaaatagggaatcctttccccactgcttgtttttgtcaggtttgtcaaagagcagatggttgtagatgtgtggtgttatttctgaggcctctgttctgttccattggtttatgtatctgttctggtaccagtaccctgctgtttagggttgctgtagccttgtagtatagtttgaagtcaggtagcatgatgcctccagctttgttctttttgcttaggattgtcttggctatacgggtcttctttggttccatatgaaatttaaagtagtttttttctaattctgtgaagaaagtcaatggtagcttgatgggggtagcattgaatctataaattactttgggcagtatgggcattttcatgatattgattcttcctatccatgagcatggagtgtttttccatttgtttgggtcctctcttattttcttgagcagtaatttgtagttctcctttaagaggtccttcacatctcttgtaagttgtattcctaggtattttattctctttgtagcagttgtgaatgggcgttcactcatgatttggctctctgattgtctgttaatggtatgtaggaatgcttgtgatttttgcgcattgattttgtatcctgagactttgctgaagttgcttatcggcttaaggagatttggggctgcgatgatggagttttcaaaatatacaatcttgttaactgcaaacggagagaatttgacttcctctcttcctatttgaataccctttatttctttctcttgcctgattgccctggccataacttccagtactatgttgaataggagtggtgagagagggcagccttctgctgtgccggttttcaaagttaatgcttctagcttttccccattgagtatgacactggctatgagtttgtcataactattccataactattcataactattccataactattccatatattccgtaactgttcctggtttattgggtgtttttagcatgaaggggtggttagcatgaaggtgaattttattgaaagccttttctgcatctgttgagataatcatgtgatttttgtcattggttctgtttatgtgatggattatgtttattgatttgtatatgttgaaccaaccttgcatcccagggatgaagcctgcttgatcatggtggataagctttttgatgtgctgctggattcggtttgccagaattttattgaggattttcgcgtccatgtttatcagggatcttggcctgaaattttctttttttgttgtgtctctgtcaggttttggtttcaggaagaagctggcctcataaagtgagttagggaggagtccttctttttctgttgtttggaatagtttcagaaggaatggtacctctggtagaattcggctgtgagccatctgggctctttttggttggtaggctattaattactgcatcaatttcagaacttgttattggactattcagggattcgacttcttcctggtttagtcttgggagggtgtatgtgtccaggaatttatccattccttctagattttctagtttatttgcatagaggtgtttatagtattctctgatggtagtttgtatttttatgggattagtggtgatatccactttatcattttttattgtgtctatttgattcttctctcttcattggtctggctagtggtctattttgttaatcttttcaaaaaaccagctcctggattcattgattttttttttaaagtgtttttcatgtctctatatccttcaattctgctctgatcttaattatttcttgtcttctgctagctttcgaatttgtttgctcttacttctctagttcttttaattgtgatgttagggtgtcggttttagatctttcccactttcgcctgtgtgcattagtgctgtaaatttccctctaaacactgctttaaatgtgtcccagagattctggtatgttgtgtctttgttctcattggtttcgaagagcttatttgtttctgccttaatttcgttatttatctaatagtcattcaggagcaggttgtttccgtgtagttgcgtggttttgagtgaatttcttaatcctgagttctaatttgattgcactgtggtctgagagactgtttgttatgatttccattattttgcatttgctgaggaatgttttacttccatttatgtggtcgattttagaatcagtgctgtgtggtgctgagaagaatgtatattctgttgatttggggtggagagttctgtagatgtcagtcaggtcccctcggtccggagctgagtccaagtcctgaatatccttgttaattttctgtctcgctgatctagctaatattgacagtgaggtgttaaagtctcccactattattgtgtggaagtctaagtttctttgtaggtctctaagaacttgctttatgaatctgagtgctcctgtattgggtgcatatatatttaggatagttagcttttcttgttgaattgacccctttgccgttatgtaatgcctttctttgtcttttttgatgtttgttggtttaaagtctgttttgtcagagacaaggattgcaacccctgcttttttttgctttccattggcttggtaaatattcctccatccctttattttgagcctatttgtgtctttgcatgtgatatgggtctcctgaatacagcacgccagtgggtcttaactctatccaatttgccagtctgtttcttttaactggggcatctagcccatttacatttaaggttaatattgttatgtgtgaattcgatctgtcatgatgctagctgtttattttgcacattagttgatgcagtttctttgtggtgtcagtggtctttacaatttgttgtttttgcagtagctggtatgggattttcctttccatatttagcacttccttcaggagctcttgtaaggcaggcccggtggtgacaaaatctcttagcatttgcttgtctgtaaaggattttatttcttctttgcttatgaagcttagtttggctggatatgaaattctgggttgaaagttcttttctttaagaatgttgaatattggcctttactctcttttggcttgtagcgtttctacagagagatctgctgttagtctgatgggcttcaccttgtaggtagcctgacctttctctccggctgcccttaacattttttccttcctttcaaccttggtgaatctgatgattatgtgtcttgggttgatcttctcgaggagtatcttagtggtgctctctgtatttcctgaatttgaatgttggcctttcttgctaggttggagaagttctcctgggtaatatcctcaagtgtgttttccaacgtggttccattctccctgtcactttcgggtacaccaatcaatcgtaggtttggtcttttcacatagtccgatatttcttggaggctttgttcgttccttttcattattttttctcatcttgtcgtcacactttatttcattaagttgatcttcagtctctgatagcctttcttctgcttgatcgattcggctattgatacttgtgtatgcttcacgaaattctcgtgctgtgttttccagctccatcaggtcatttatgttcgtgtctaaactggttattctagttagctgttcctgtaaccttttatcaaggttcttagcttgctttcattgggttagaacatgctcctttagctccgaggagtttgttattacccaccttctgaagtgtacttctgtcagtttttcatactcattttctgcccagttttgttcccttgctggtgaggagttgtgatcgtttggagaagaggtattctggtttttggagttttcagcctttttttggtggtttttcctcatcttcatggatttgtctgcctttgatctttgacgcggatgacttttggatagggtttttgcgtgggtgtcctttttgtttttgttgatgttattgctttatgtttgttagttttccttctaacagtcaggcccctctgctgcaggtctgctggagtttgctggacgttcatttcagaccctgtgtgcctgggtatcaccaccagaggctgcagaacagcaaagcttgctgcctgctccttcctctgaaagctttgtcccagaggggcacataccagatgccagctggagctcttttttatgaggtgtctgttgaaccctcctgggaggtgtctccccatcaggaagcatgggggtcagggacccacttgaggaggcagtgtgtcccttagcagagctcaagtgctgtgctgcgagatccactcctctcttcagagctggcagacaggaacagttaagtctgctgaagctgtgcccacagctgcctgttcccccaggtgccctgtcttatggagatgggagttttatctataagcacctgactggggctgctgcctttctgtcagagatgccctgcccagtgaggcagtctagagaggcagtctggctactgtggctttgcagtgggttctgcccagcccgaacttcgccgcagctttgtttacactgtgaggggaaaaccacctactcaagcttcagtaatggtggatgcccttcccctaaccaaacccaatcaccccaggtcgacttcagaatgctttgctggcagcaagaatttcaagccagtggatcttagcttgctgggctctgtgggggtggagcctactgggcaagatcacttggcttcctggcttcagccccctttccatgggagtaaacagttctgtctcactggggttccaggtgtcactgggtacgaagaaaaaaaagaaacaacagaaaaaaaaaaactcctgcacctagctctgcccaaacagccacccagttttgtgcttgaaacccaagaccctggtggcgtaggcactagagggaatctcctcgtctgtgggttgcgaagactgtgggaaaagcatagtatttgggctggaatgcaccattcctcatgacacagtccctcaaggcttcccttgtttaggggaggtagttccctggcccctagtgcttctcgggtgaggcaacaccccaccctgcatctgcttgcccactgtgggctgcacccactgtctaaccagtcccattgagatgaaccgggtacctcagttggaaatgcagaaatcacccaccttctgttatggccttgctgggagctacatatcggagctgttcctattcagccatcttgccagatccccctgtttgtttgtttgtttgtttttcatgtaaatataaggtccttgtagactctggatactagacctttgtcagatggatggatagcaaaaattttcttccactctgtaggttgcctgtttgctctgatgatagtttcttttgctgtgcagaagctctttagtttaattagatcccatttatcaatttttgcttttgttactattgcttttggcgattttgtgatgaaacttttgcctgtgcctgtgtcctcaatggtattgcctagattttcttctagagtttttatggttctgggttttacagttaagtctttgatccatcttgagttaatttttatataaggaaggggtctagtttcagttttcttgatatggcttgccagttctcccagcaccgtttattaaatagggaatcctttccccattgcttgtttttgtcaggtttctcaaagatcagatggttgtagatgtgccatcttatttctgagttctttattctattccattggtctatgtgtctgtttttgtagcagtaccatgctgtttgggttattgtagccttgcggtatattttgaagtccagtagcatgttgcctccagctttgttctttttgcttaggattgtcttggctgtatgagctctttttttattccatatgaattttaaaatagtttcttctgattctgtgaagaatgttaatggtagtttaatggaaatagcattgaatctataaattacttagggtggtgtggccatttttgtaatactgattcttcctatccatgagcgtggaatgtttatccatttgtttgtgtcctctctgatttccttgtgcagtggtttgtagttcatcttgaagagatccttcacgtcccttgctagctgtattcttagttatttttttctctttgtagcaattgtgaatgggagttcattcatgatttggctctctgcttgcctgtagttcgtgtataggaatgcttgtgacttttgcatgttgattttgtatcctgagacgttgctgaaattgcttaaaagcttaagaagcttgtgggctgagacaatggggttttctagaaggagtatcatgtcatctgcaaacagagacaatttgacttcctctcttcttgtttgaatcctttatttctttctcttgcctgattgtcctggccagaacttccaatactatgttgaataggagtggtgagcgagggcatccttctcttgtgctggttttcaaagggaatgcttccaccttttgcccattcagtatgatacgggctgtgggtttgtcctgtatagctcttattattttgaggtatgatccatcaatacctagtttattgagacataacatgaaaggatgttgagttttactgaaggccttttctgtgtctattgagataatcatgtggtttttgtttttggatctgtttatgtgatgaattatgtttattgatttgcgtatgttgaaccagccgtgcatcctggggatgaagccgacttgatcacggtggataaggtttttgatgtgctgctgtattcggcgtgcctgtattttattgagaatttttacattgatgttcatcagggatattggactgaagttttgttttttgttgttgtatgtctgccaggttttggtatcaggatgatgctggcgtcatagaatgaattagggaggagcacttccttttcagttgtttggaatacttttagaagaaagagtatcagctcctgtttatatttctggtagaattcagctgtaaaaccgtctggttctgggcttttttttgtttttttttttagttatttattactgcctcaatttcagaacaggttattggtctagtcagagattccaattccttttggttcattcttgggagggtttatgtgtccaggaatatatccatttcttacagattttcgagtttgtttgcattgaggtgtttatagtattctctgatcattgtttgtatttctgtggggtcgccagtgatatcccctttatcactttttattgtgtctatttgattcttttcttctttattagtctagttagtagtctatttttattaatattttttaaaaactagctcctggattctttgatttttttttttttttttgaagggtttttcatgtttatctccttcagttctgctctgatcttggttatttcttgtcttctgctagctttggggtttgtttactctcagttctctagttcttttagttgtgatgttaggctgtcagtttgagatctttctaactttttgatgtaggcatttattgctataaatttccctcataatgctgcaaatctgtgtcccagagattctgatacgttgtttctttgttcttactgatttcaaataacttcttgatttctgccttaatttcatcatttagccagtagtctcagaagcaggttgttcaatttccatatacctttgtggtgttgagtgggtttcttcatcttaagttctgatttgattgcattgtggtctaagagactgtttgttatgatttcagttattttgcatttgctcacaagtgattttcttccaattgtgcgatcagttttagagtgccatgtggcaccgagaagaatgcatattctgttgtttttggggagagagttctgtaggtatctgtcaggtccacttgatccagagctgagttcaggtcctgaatatctttgttaattttctgtctcaatggtctatccttgatagtagggtattaaagtctcccactatacttgtgtgggagtgtaaatctctttgtaggtatctaagaacttgttttatgaatctaggtgctcctgtattgggtccatatatatttaggatagttagctcttcttcttgatttgagccctttaccatcatgtaatgcccttttttgtcttttttaatgtttgttggtttaaagtctgttttgtcagagactaggattgtaacacgtgcttttttctgttttccatttgcttggtaaattttcctccatccttttcttttgagcctatgtgtgtctttgcatgtgagatgggtctcttgaatacagcacagcaatggatcttgactctttactccagtttgccattctgtgccttttaattgggggcatttgcccatttacatttaaggttactattgttattgtgtgaatttgattgtttcatcatgatgctggctgattattttgcagacttgtttatgtagttgcttcatcatgtcactggcctgtgtacttccatgtggtttcctagtggttggtaatggtttttcctttccatatttagtgcttccttcaggaactcttgcaaggcaggcttggtgctgatgaattccctcagcatttgcttgtctgaaaaagattttatttctcctttgcttatgaggcttactttggccagatacgaaattctaggttggaaattcttttgtttaagcatgttgaatatcagcccctaatgtcttctggcttgtagggtttctgctgagaggtctgctcttagtctaatgggcctccctgtagagatgagcggcctttctctctggctgcccttaacatttttttttcttcatttcaaccttggaggatctgatgattatatgtcttggggttgatattctcatggagttatcttcctggggttctctggagttcctgaatttgaatgttggcttatcttgctaggttgaggaagttctcctggatgataccctgaagtgtgttttccaacttggttccattctccttgtctctttcaggtaccccatcagctgtaggtttggttttttaacataatcccatagttcttggaggttttgttcattcctttttttctaatcttgtctgcctatttcagcaagatggtattcaagttctgatatcttctcttccacttggtctattcagctattgatacttgtgttggcattgtgaaggtctcatgttgtgtttttcaactccatcaggtcatttatgttcatctctaaactggttattttggttaacaggtcctgtaatgttttatcatggttcttcacttctttgcagtgagttagaacacactcctttatctcagcaaagttcattactacccatcttctgaagccttcttctgtcaattcacccatctcaagcctcggcccagttctgtgcccttgctggagacatgctgtgattatttggaggagaagaggccctctgactttttgagtttgcagcatttttgcattgattctttatcatcttcatgggtttatctacctttgattttgaggctgctgacctttggatggggtttgtgtgggtcttttttgttgatgatgttgttgttgttgctttcggtttgtttttcttttagcagtcaggcccctcttctgtaggactactgcagtgtgctgggggtccattctagaccctattctccggggcccctcccatccctggaggtatcaccaggggaggctgcagaccagcaaagatggcagcctgctcctttctctgggagctctgtcccagagaggcactgacctgatgctggatagaatgcccttgtatgaggtgtctgcaggcttttgtcaggaggtctcacccagtcaggaggagcaggatcagggacccacttaaataagcagtctggctgcccgttggcagagtgggtgtgctgtgctgtggggaatccccctcatccaggctgccctgactctccagagccagcaggcataaaagactaagattgcttatccatgataccacagccgcccctcctcctaggggctcctgtcagggatatcagagttctgtccataaacccctggctggggatgctgaaattcccacagggaggcactacccagtgaggaggagtggatcggggtcctgcttaaagaatcagtctggccaagaactgacccagccgctgtactgtgatgtggggagttgcttctggtccaaaccacccggtcttgctggcactggtggcaggggaaaacagccaactggagctgcagtgatggcggctgccccttttcctcaggaactcagttgtcttaggcagtctcaagtctgatgtgctggctggtggggattccaagccagtggattttagctcttggggttctgtgggaatgaggtcacttggctccctggctttagcccccttcccatgggagtggacagatgtcctgcctcgctggggttcccagagctggagtatgcaaatactcctatgtctcagtgtctgctcgagacaccaccctcctgagcagctgccgtgattctgcacagttctgtgcttaggacccaaggccctggatgcatgggctcatgagggggacctgctgatctgtggattgcaagaatctgtgggaaaagcatggctttcagggaggggtagcacaatccctcactgcctgccttgaccaggggagggagccccctttccccctgccgccttgtgaagctcccgggtgggcccttgctccagcctgcctttccttgctctccatgggtcatgccaactgcctcgtcagtcccaatgagagaaccttggtacctcagttgaagatgcagaattcactcaccatttttgtccttctcagtggaagccacagagcagagctgtttctgttcagccatcttggctgcacctgacttttatttattaaaaaaaaaatttttttttgttttttttgagacaggctcggagactctgtcacccaagctggagtgcactgtctcatcatagctcactacagcctcgaaatcctggtctcaagttactcatgcttcatatagctgggaccatagatatgcaccaccacatacagctatttaagttttattatagagatggtatctctctttgttgcccaggctggtgtctaactcctggactcaagcgatcctccaaccttggcctcccaaagtgctgggattacagacacgaaccaccacacccagcctcaaaggacttttagattgacaaatttgagttacattgcccgtattgtgacttgcgctatacttaccaactttcacttgacactgatattttctaaatgcttaaggctatagaacaaacagtaaaggcaaagtcacagccatccttgagaaacttagttttgaggtgagaaatcaggagttagcatcacttaaatcaggttagagtttgtagaaccaaagttactgaagtagagaagtgtatatgatggcatagctcattacacatttcctgtatattaggagcctcattatataattgtttttttttctgtctttttaacgtacccaaagtattgaaagtcgagggagtgccagagacaagtaagattatgttcgttgggaaattcatattatggctacgaaaataactataggcaaagataccatactagtatataatgcatcctgctggtctgttttatcccattaaaaaacttcgcgcgcttttattaggaggtttatttttcttatgactgggggaaacaaaattagataatttacctttgaaacagagttgcttatctagcattcttataccttccttatctgttattagtgagcttgtttactgtgactatttctgcctttcaaagttgatctgattaaatttggttaaaattattgtctaatcttccattagctgtttttctttgtgagcatgtaaatactgtagacaaaacaaaaaaaatgatacatcttcataacttaaggggtcagctaaactgaaatcaaagtactgtgacagcaattaaatcttttttttttttttttttttttttttgagatgaagtttcactcttgttgcccaggctggagtgcaatggtgtgatctccgctcaccgcaacctctacttcccaggttcaaacgattctcctgcctcagcctcctgagtagctgggattacaggcacacaccaccacgcctggctaattttttagtagagacggagtttctccatgttggtcaggctggtctcaaactcccaacctcaggtgatccgctgccttagcctcccaaagtgctggaaagcaatttaatctttagtgggcttttagacaaataattgagactaaactttgaattaattaaacttgagctttttatggtggtatttatttaaaaatatataaactaaaatttgccgttttttaacaattttaagtgcctaatagcattaattacattcagtgttgtgcaaccatgatcactatttctaaaatgttttcatcactccagatacaaactctgtaaccattaagcaataactccccactctcccctcaccccagcccctagtaacttctaatccactttatgtctctgtgattttgcctgttctagttatttcatatcagtggaccatgtgatatttgtcctttgtgtttggcttatttcacttagctcagtgtttttaatgtttatccatgttgtagtttgtgtcagaaccccattccctctttgaataatattacatggcatggatatacttcctctgttaatggtcacccgggttgtttccatcttttggctattgtgaataaggctgctgtgaacaatggtatgcaaggttctgtctgagttcctgcttttaattcttttgggtgtatacctataagtggagttgctcagtcataaaggaattctatttttagctgtttgaggaagcctcaaactgttttccacagtggctgcaccatttacactcccaccagcaatgtattagggttccagtgtcttgtcaccacttgttattttgttttttctctttaaattatagtcatactaataggtgtgaaatggtatgaaccagttgcatttttaaaagtacgtttaagataatttgtttatgaaatatttaaactttggttaaaagtgccctgagttcaacagttttaaaaaattgtcatattttaaaacatttatataattgctatggtctgaatatttgtgttcccccaaaattcttacattgaagttccaactttcaagatgatggtattaggaggtgtatggcctttggaaggtgaattaggtcatgggggtggaggccccatgatgggattagcatctttataaaaaacacctgagagagaaagagagcacatgccagagacccccacctctttcatcacatagtgttacagtgaaaagaccaagagcattattagcataacctgggaacttgatattaatgcaaattctcaggtcctacctaaatcggaagtctggtgctagggcttagaatctgtgttttaacaagcgcttgaaatgattatgatgcatgctaacgtttaaaccgttctctgtatttagagttcttttcttgtcttttatagcatgatgagaatctatgcatcttggctcagttgcagtgttatcccttctggaaaggctccccctgccccagtcacctcctgcactgggctctcagagtgcgctagtatggagtgctgatagttggtttgatgttccttccagtttgagaaacccttccgtgtagggatttgtatctcttttacttctttataaaccatcatgcttagcaaactgtagatgtctttttaaagtttgttcagttgaattgtgtgtccagtgggtgggggacagggtacataaagtaattatagggaagtacagatgaagcaggttgatacttgattcatggggttgtgaaaacaatggcaaaagttgagttaacatttttcaaaagttttcttggggggttgtatcatgctttcttgttatatagctttctgcctacttttttttttttttcttattttgagagtggtgtatgctagttagaattcagaattatcaggaggaactttatcttagtctgttttgtactgctatgacagaataccacagactgggtaatttataatgaacagaaattacctgttcattatcctggaggctaggaagtccaagactgagggaccaaactcgcccttttatatggaactctctcctcagataacagcattaagccattcatgagggtggtgcccccatgacccaagtacctcccattccatcctgcctctcaacactgccacattggggatcaaatttccagcacatgaactttgggggacacattcaaatcatagcaaatttgctttaaaatgcttataaggtatgaaatgaactttgaagatgagtgtggggaggttctgagatgtttttgttttcacatttaggatacagcaaagtgtcttttaaggaaggaatcctttgttattaattcactagtttgatgcatgctttagatttttaaaatataggacacttttaccctgtgaagtttaaatatgtgactagttaaagatattaaagttttggcacacattttctcattaagcaatgagattcatattttctagtttatgggataaaaataaaaattcgatcagtggttgctacagtttcaatctcattacagctgcagtggagttttcttattaagacaaacctcttttcaaccacagatacactttttagcttaggcttcacaaagcctcataactgaggttgcattggcattgagtatcttgcctttaacagacttttaggactttatttgtttcccacaattttctgcatgtttgtctcaaatgaactataaaatgattcagtgacaacatgtggttttaataacaaacaagcatgggcaaatgaatgtagacttagaatttgaagttttgtacatatgccatggcttcaacttctaactgaatttatagctcagcactcagtcagtggtaaattatcagttgctagatggactttttcattctagacttcaattattttgagtgcctgatattgaagaccacagatcattgatataaagaattttctgcaagtttttaatagtatatttatagttaggttttgtgatcaagtgggagcaaatttcccccaatctgttttttaccttcttggtttttaattattacagtttatattgcatcaaaatgtaaatttcaagataagtaaggtattataaaactcatttctttacaaaggtttctattgaaaatgagtctttttgaagtaggaatgtactatagtagctgctctgagcattagaaataggcattgtggagatgcctctttcctctctgaggtggaagagcatgaggctactaatgtgtgtaaatgcggtctttccctcagattgggtggggcaatggaaggggtgatggaagagagagggttagtagatgccacattggtattgagtgtcttgcctttaacaggctttgactgaactaaaaccacattttccagtcaaccttatagtgataaaaataatactctggtcttaattaatgtactgtgtctaaaataatgtattatatcagttattgtaaccacccaacaagttcttgcctgctgcccaggcagagccaatttatcaagacaagggaattgcaatagagaaagagtttaatacacatagagctgggtaaatgggagactggagttttatattactcagcctcagtgaaaattcagaggctgggattttttaaagatagtttgtctgtaatcccagcactttgagaggccgaggcaggcggattggttgagccttaggagtttgagaccagcttgggcaatgtggtgagatgctgtctctacaaaaagaaaaaaatacaaaaattagccgggcctagtggtgcgtgcctgtagtcccagccatttggggggctctggtgagggatggcttgagcctgggaggtcagggctgcagtgaaccttgtttgtgccactgctctgcagcctgagtgacaaactgaggccctgtctcaaaaaataagtaaatcagttaaaataaagatagttttgacatactgggtgtggtggtgtgcgccagttgtcccagctacttgggaggctgagacaggaggatctgttgagcccaggaggtctgggctgtagagcagtatgccaattgggtgtccacactaagttcagtatcagtgtgatgacctcctggaagcaaggaccaccatgttgcctaaggaggggtgaactggcccaggttggaaacagagtaggtcaaaactcccatgctgatcagtagtgggatagtgcctgtgaatagccgttacactccagcctgggcaatgaaaaaaaagtgtgtctttaagaagactccctgtttgttaaaaagtgtgtgtgtgtgtgtgtgtgtgtgtgtgtgtgtgtgtgtgtgtgtgtgtgtagtttgacagcagggggctagggaatggggaatgctgtttggttgagtgagggatgtaatcctagtggattgaagctggttttcttgctgtcttctgttcctgagtgggattgcaaaactagttgagccagattttattggtctgagtgataccagctggtctgtcagaatgcagagtctgaaaaataccttgaacaccagtcttaggtcttacaatagtaatgttatccatgggagcaattggggaggttaggaatcttgtggcctctggctgcatgattcctgagccataatttctaatcatgtggctaatttgttagttttacaaagggtatctggtccctaagcaaggagggagtttgtttcaggaaggggctgttaccatctttatttcaaagttaaactctgaactaaattcctcccaaagttagtttggcctacacccaggaatgaacaagggcagcttgggaggctagaagcaagatggagttggttaggtcagatttttctcactgtcgtgatttttgcaaagatgatttcattattaaagttcttttgtaagcacaggtttttttttttggctttttttgccttatattctctgtcttttgggagaaggaaaaaatcttttttctttactctcttacattttatagttgggggcctacaaattatagcgacaaaagacagagtagcaagagaaaaaatagatttgatggtgtatatatgtacccaggaattcacaaataaatgtgactcaaatagttcaaattttgggcttatatactatcttattagggggtggagagggtccttctgagagaaattcagattggatttttctttatgttggaggattgacaacccttgccttatcttggtctccttcaatgtttccacaattctagtacaagcatttccctcagaagccttcatgcagcttcagtttatgggagacgtaaggcatatattcagtgaaaaataaaagatagccagaataaaaatcaaatacaaattaaagaaaggtgaggtgatgcacacctatcttgtttatatagtagcttaatgaggttttgtagattgattgatggatggataggtggtcagctcatggattcatttacaaaggcatattcaatctttcatatgtaccaggtactatgcataggggaaacatctgttaagaagatcagtgtgggccttgcttttgcctcttgcctagttcacagtctggtaaatgaaaccaacattgtttaattagaatgtaatgagtgctttataggcgctatgagaatgtctaagtaggacacctgatctagtctggaccagttaatggcattttcctgagggtatgctgttgggtctgagttctgatttatgaatagtaagtaactaggtgataagggggtgcagggaaggcccagcagcccaggcagaggaatcatatgtaagaaggccccggagataaggccagtgtagcgtaaagcaccaaggagggcccggttatgggaaatgagccagcgcatgcagggcctccaagaccatggaaggacattttccttcatcctaaatgcaacagaaaatcactgaaggttttataaacagaaggtgatcagtttggtctgttttcttaatgttgcttctggctcttctggagaatggatcgtggtaggggaataaaaagaggttgaacagagatgagtcggggtgttgcagttgtccaggtgaaaagtaatagtagcttggactaggagtacattagggagaaatagattgaagaaatatttaggagatcaaattcacaagataggattggctgctagcttctgaagagaaatgaggtgccaagaaggatccacagatttctgacacaaccacctggatgcatagtggccatattggctgagctcaggaacccaggagaaggataggctttgggggttggggcttcagcctatgggctagattgccggacatacagagtgcctgtgaaatagctatgtggagataatgagtatctacccaaatcgaaaggatattcctagcacaggaaaaagaggccagaatctggaagacattacgaaaaaaatcaaaggtggaaaagggggaaatgtccctgcaaagttctgaggagatgcatcctcccaaagtggctcttcttcctgaggaggggttgcctgccctggtagagtccgctgctctccttgaaggagttaatacggttgtggtgacagcttctgccccagaggctttgctggcctcctgggccagaattgcagccagggcagggatgccagaggcagtgagtggaatctccacaagagtggtgtcaagtggcatgtgctccacgggagaagtctccctgcagacacagatggttgggttcacctccagtttcatgctggacaagcctgggttcccgagaagcaggaagggagagtgagtgcacgcacgcctcttgcttcctgcctccaattttccacccccacaccctgcagacagtatgttgagccccaaatgtgttcataggaacaagatcttcagaagcctccagcggaaaaagaataccaagaaaaaggacacatctctggtaattaatggcagaaagcccggacagtcgagtctgtggtgctgctgacaggtgaactctggtcctctccacacctacttataggccatgcagactggtgggttgcagatgttagcctaagaccctggcagtacctgctgctttgtggtttcaggtagagactctcatgtttaaaaatggaaaagcattttacaaattaccatttaattctagttaatacatagaaaaagtcattcacactacccccctaaaatagaatgacttctgctcttttaggtgggaacttcttcagctgagcattggcaacaggttgagtgaagaaacagtagtttgtgtctgtgctcaatttccctcctcacaatactggttattttaggagttgctccattccaacttgtatatttcataaattgtaaagtattttaagtcaaagaaaggccgttaatattctccctccccaaaatgcatgatttttaatattcaaaataatgtttttcaaagttttcttagtaacctaagatttctgtggtttgactccaggataaaaacacaaggcactttgtctgtattatttccacttataattgttttatatatttctgctgttaaaaatgtttaagatcgcttcccactcataaatatataatacattgaacttaaaatatatttgttaaccagttctccaaaaataaaaatgaaacgtgtatataaaataattcatttgttatatttagggaactgtattcattgcaatgtaaataattgttagtgttcttcactgaaaggattaatccaaaaaggatgatttttttttcatgattcatttgcttatttttttgtttattagttggtggtatgggttggatcatttgttttaaaaccacttgttatatgattgacatacaaaaagctacacgtatttaatgtatcaaattgagtttaatttgtaattttttatgtacttcctaaatttgtagtcctgtgagtcttaggacagatctgtttttcacttgtcctgtgttttaatgtctgtttccaacattgctttattattacaagtaggggattttttttttttgccactttaatgaagatacaaaaaataatgcgctgaaaggagtggcggaattggaaaatttgtaaccatcatgatatggaattaataggtttgggaaagaatcctcaaaaatattaaagtgaaggaggaaagtttgttaagaagcaagatggttttatggtctcagtgttaataacctcccgcctgccattggttgttggtggtcagaattgttcagtgtaataaacaatacacacatttttcccttaaaaaagttgtgcagattattttgtgttttgtttagtattgtgatgatgatgcattcttttgtaatgatatgaaaagagaataaaagtcctatcaagatgcaaattcaaagaacaggttatttcatacagaaggtgtttctttatagttagacttcaactactttccccgataacttgatttaatatgaaagctggttctgtgaggcactcctcacgtgaatcagtgttagaccttcatagtcataaactcagaacatgtggtcctaacacattacctactaataaataggagatcagctgtggactctagatttcctcatcagctcacatatttttaaatggtttattttcatcctctttcctttgaagataggactctaaaaggtctgtcaggtgatccacttctgtttcctatttaacagtacctccattcatcgacagctgctaaagtcatctatattaaaagatctttaaagtctctcagcattcaagaaataacttaggcatctttttagaagtattatacattcttaatcaataaagcctgtgtgtcttgaacatttcctagttagcagtaaaacacttagtttctctttataagatttttcttttaataaaattacttgcattttgacttatgcccttaagtttctatttgttgtctaaatggcaccatttaaagtgttttaagaaatttaatatttctttattggattaggagaacatatctttaaggaaaaattaccctcttagcaggtgatttacagtattattttctcctggccaacctttttaaaaatccaaaatatgtgccacctagctttttaaaagtttcattagaattagttatgtattatgacgtatttgtgaagtatgtaaagtgcttcagacagcacgtggcacattgtgatcactaagggtttgccattattattcttaccttgattttaaagacgtgaaatatggatatgtgacttttttggtttttacattggaatttcatattaagtcggtggccctttcagtaaaataagagcttactgtaaagttctctgcaaaagattttccattttcatatttaatttgcatgcataccataatttttatttctctcctcttggagtctctctgtaaatttctttttaatgtgtcatacttaaggacctcttcattttcttaaaattctgcatccttctgttaaccaaacacatttagaaagtcattcaaattttatgcttgtaagtggtactgaattggaaaaccaaaggattgtttaccccaggagcaagttggagtgtgtgcctgcttaataatgaaaaacattgtgatcagtttgcttttaactagttctcccttttttttccctatttccttacccctaagaatgaatataagtgttagacaacgttgagatcagtttccattagagttttaaaagaaatttttctattataaaggaattggatatttattacatttttaaatgtaagaaaattgaaagaagaaaggcactaacagacacgaaaagaccattagtattttgtgacagattgttccaatttttttcctcctactttattcaattttacttatttgtttatttatgagctagagccttgctccatcactgttacctcgaactcctggcctcaatccatcctcctgcctcagactcccaatgtgctgggattataggcatcagtttctccaatgcattttaatactgatgtaggtagagattataaattaacttctagatttaaaagctatggtattgatctttataactgctttagcatgttttttgtagggatctaatccgtcagtaaataatcacagagaacctcctatgtgccagatgctgttctaggggctttgattcattaggacaccctactgtcaccccatccttacctttatgctttctgctcatttttcagtacactcttgacatcaggagcttccagtaagttagcctggcagataggatgcagtttgtgtgagagagcaagctgtcaaaagtgactccagggtctgctttggcctatacaactgggcctatatagtcatctttaagatggagaaactgtaggtagagcaggtttgggaggaagattagaagttgagtttggacatgtttagtttaacatatctattagacaacctaatggaaacgctgagtagacagggaaaaacactgatgttccaatcagatgtgacaacaggtcagccagaattttgcacaattatcaggattatttaaatgttgtatatgttatatatatgtgtgtgcgtgttaaatgttagtgtacaacaggagtaggatatatataaaatatatttcatgtgtgtctgttcatatctgcatctatatatttctgtgtattctacctctgttgtaggcagtgtgctttatcctaacttgtgccttgagatattagctaacaatgataatatctatataagtgatccttaagtaaatagacaaatggtggggtggggggagtgggtaggcattttttttttgtcagaatacacgaagtttgtaaactgctgaaacatccacacaaacttttgcccattcaaaaagttaaatgaatgccatgaatgattctgtctataaattttttaagtaacacttcctcaaatatgaaactttcttataagaaaattcttttgatactggaagaaccacactcatttgcaaggaatcagatccaagataaactaccagcctatagctgtttgtccttcaagaacagaatccatgggaaaatcttggttactccttttcttgggtagtgatttgtgagagtttgtatatctcagtcattttttaaaaccttagatttattattaatataatttagatattatttacatatatggaaactatctcttcttttaagagagccttatttaaagtgcttattaattattgtttagtttttatatctatatataactctggtactatgctatatctaaacttctgggttttctagggcaaaagtaattgtatgagagtaagaaaagttttttctttctcccttcctcccttccttttcccgtgtttccaccaagttattttttcttttactgtattcaccagtactcttaaggaatgttgattgatactgcaaacagtagacatccctaggtagtttgaatttgtatttcatttaactgctgtattttagtttgagtattggtttgtgatatactgttttcataaagcatggcttttgttgttacttaataccctttaaaaaaatcccatttagtcattttaaccttttaaatctcatttccatgcctatccttttatttccaagacttctttattttgttttatgtgtgtgtgttttttaaacagaatatagataggtcttttaatggaataatttactttcttcatgtgtcatatagttttttcttgctttctttgctgcatattttaacttgcagtttgttatatctggtttttgctggtttgatcaatttattttgggtttcttttttaaaaaatgtcttgttactttggaaattctactgtatatttccattccattaatggtgatcttttctttccctgtactcagaaatgtttatatgccattatttaaaaataaaacatgtgactttccccaccaacttgtctttgctataataacttctgtctcctgcttacatccctcctcagtaaggtgataactttggaatattttcactttcctcttgttcagctttccccacacccagccaaaaagttttttgtttttttttgtttgtttgtttgtttttgagacagagtctcgctgtgttgcccaagctggagtgcaatggcacgatcttggctcgctgcatcccccgcctcccaggttcaagcaattctcctgcctcaggctcttgagtagctgggattacaggtgcgcgacaccaaaaattagcctggctaatttttgtatttttggtagagatggggtttcagcatgttggccaggctgatctcgaactcctgacctcaggtgatccacctacctctgcctcccaaagtgctgagattacaggcgtgagccaccacagcctgcctccagccaagaggtttagcatgcacctactcctactgtgtttagcccttcttccaatgctttgatattcctttgacagtttcatactttcaattcagtccttagcagataatactttgccgtacatctgttttgtttcaagtattcttatttagaatttattacatgttgctataacaattaatagtactcatttagattgattgtatataactaccatatttcataaaactaaagcactttttttttgcattttagcacctctggaattgagatgtgccttacaattgatgattttctagaattagacttagaagtgtaatttggcagcacttggattttctttttttatttttgttgagatgaggtctcactgtgtttcccaggctggtcttgaactcctgaactcaagccatccgcctgccttggcctcctaaagtgctaggattacaggcatgagccactgtgcccagccagtgcttgaactttagtatctatctagtggaatagatacagatacatgaaactgtgtatctatagagaaagcaggttcaggcacagacagggtttacttcttgctgctcttgtctctcctgtccttccccagaggtctctaattcatttgtccctcaatcagagatctttttcaggtgtttttctatatgacatatgtgggtggtgtattttctgagtatccatacatacacttttttttcaggacaagtgacagatgttgtgtttggggtttgctacttttctcttagtattttgctagagccattgctatggcttccattgtcgcgggtgagaagtctgatgcctctgatttttttttcctgaagtactatgttctacctacctgtaagcttgtaaaaatattttcttacagagtcaggaatttagtaggatgtgtcaagatctgtgtgtagaataacatgagctcttttaatcggcagaccaaggtctttctttggcccaagcaaatattcttctgctttattactgcctctcctccgtcttttcatctttcttcagctggtactgctgttcatcttattagatctgtcctccaagtctcttatcttttctgtcgtcatttctattttgttgctttgagctgttttttccatttgaccttccagaccacaaatttggatcttcgtcatgagccattctttccttcatttaatctactatatggtttatttggaaaatcatgtttttagatgtgggaaagcttctctctgctgtagttaaatctccccagtgtcccttaatttttccgactcatactggcctttctctctccaagcacctctgtttgatttggggtttattcccttcatcttgacccctgtctttctggatgctcagcctctttatgtgttgttgtgttttcttggtcagcttattaggacccaggtctgattttggcctctaatgattcaaggagatgtagatgttctgccttccctgttccccacccaagggtcatcagatctctgtgggccaggcttttcttagaaccgttagtttatggtccttgttctagggttcaaagaggcttgtctccagatacttgtccagaacctagaaaaacaaaaaacaaacaaaaaacacacactccagttccctcctctgtattacagagagtgcaagtcttcgcttccatttagctgtctgcaggtcccggggctgtgttctgttgcagcagacagattgaaaatggtaatggaggtaaagggaggtgagtttgtgtgtgactctttctggaatctttttgggcctagattttttatgttttcattcccttaacagttgtggatcttttgtctagacttaacaatagtaggtaaaacagcatttggcatggaaactagaagacctataggagtgatatattattctcaaccttttgcttctttctctctgagaagattgatgatacttccctgtctgttgcagtgtgatttgatttgttgtgtctccctgtcccatagtcagacttaattttgagacttagccaatggagtatgagtggatgtatatcagttctgaacagaagctttgtttgtttctttgttttgttttgttttgagacagagtcttgctctgtcgcccaggctggagtgcagtggcatgatctcggctcagtgcagcctccatctcctgggttccagtgactcttgtgcctcagcctcccgagtagctgggattacagatgtgtgccaccatgcctggctaattttttgtattcttagtagagacaagattttgctatgttggccaggctggtctcgaacttttggccttaactgatccaccggcctcagcctcccaaagtgctaggattataggtgtgaattactgcgccgggccctgagtggaagctttaggaggtgtagcaggtttctgtcatccctcttgcttctgccttttgacttgagaatagcatgtcccaaatatgatctgttcttctggattggattctgggtaagaagaccctcagggcaaaagccacagctttgagggcagccatagctaacccagagctaacatgtaatgtgactgggaaatacacgtgtgatgtatgccaccgagatttgagggttgtgttgttactgcagcaaagctaactgataaaatctggtttaatttcttgtttctccttttattagctgatacttatttttcctaccaactttaaaaatctgtatcagatcctacattctattttctatctctcctgatttatctcttaattggctgatataaatgaactgttgtaattggggtcaaacactgattacttgtggtagagtgtttacaagttatataataggttccaacctgtgtaacaactggggaaaaaaacagtaaattgggggcagtgtcttgtggctgttaattgcccatttattaaatgccctaaattctgctccaaattatggttgtgaagcatggcttttctttaaatgtataaagcagattatttgtagatctcaacatctggatggtggtgctgttttctattatcataaataagaattaattgggaaagcatttatggagtgactttacagagttgggaattcctgggatgtgtatctgtgcatatttatctggcctgttggattaactgacgaataaatgtaaagaatgggatttatttttgtgttttatcctttttgtatataattgatattcacttttctttggtcttagtattctgctctcaacacactgttctaacaaatattgtaaatcagcagtagatgagtagaaacagtaatattattccttggaccatgagccacaagacccgggttctcccctaactcttttagccttatcccctcccttttcttcatccctttctttgcctttcctccattcactgatgtaagaaatacgtatcgagtgtcctgttaggtgagatgctggatgtgatgagaagtaagccagacacctcccctgcctgccttatcaagcttactgtcttctcttctattcctcagccccttctgtcttccgaccatacagcagtataaattggtccatgctgcattactactaagcctcctggttgccatcttttgttaacagggctgctttcaaaggtgcttttaatactggattgttatgggaaagttggtggtggtggggagggaaggagggaggaaggaaggagagtagatgagtaggcaggtgagaaaggaggaagctatggagctgttcacagggccttaaccacccaacaagctgctttttattaatgtttttcatgattcttttctaattgtaattttgcgtaaatgcacagaggatgtatctatacaaatgatttgaatattagatgagaacctttcttgttcctggctaggttttaaaatgttattttttagaatttgggaaaccatcaattaaaacatctttggtaccagaaaaattgctcagaaatagggaaagcctggataaataagcatatgcctttgttaacaaggacatttgatagaataataagtaaaataaaatctaccttttattgttgtgtttcttgacgcattggtcattcatttttcctctcccctctttgttatctcagtaaagagatgctaaaatgtgctgctgaaagggaaggaaagttgggggtgggaaagacaatggaactgtacacagtgatgtcattctcagctgcaagaaaaaaatcttaaggcaaccggattatatttgataaaagattaaagttgcatgcaaattctaactaaaaacatctgtttcctgaccctgtgcgagttctaacgttttgataggaattctggttttggaatttctgagtcttaagtttaccttcctcaactactgcctggctattttcttaaaggactgaagtcagtactgcttaacatactggaaatgactgtgaataaccaaaaatgaacttcctggattgcttcttacatacaagaagttttcaggtttcatgaacaagaatcatcctgattgccgagtgacaactttaaaaattgtggtgtgatacagagttcattccaggaagccaatgaaaataagtggaacatatgtatatgtgtgtgtgtgtagaattagtaatagatttttaagaacttttcaagtgttcctgcttttattaagaacctcaactagcaaaaattgttcctttttaaaactttatttttaggtgaggtacaacttgtatctactgtgacatcgtattttatattttgctaaatcagacatgtgttggaaaatcttgataccataattgcactgtatcagtaatgcttacagactcctggaaataggatgaaatctaaaagcaaatattgaacattagctaggggatcagtttaaattgaattttgcattacagtcactcacttcaactgtgaaagccagtgtaattttgtgatttttcattttgattgatttgttaaacttgatacccaacagcagcagatttctttgtgttctgatatacccagatgttcacactgggcattttctaaggatgactgtactgtgaaaatgttaacgcttggtcttagcctaccatgttagtgtgaggtatgttgaggaatatttacagactgtatgatacagctagaatgtcctacacattagaaatgattgattaaacaaaagttgtgttttatgaggaagaaaaatagaaataagccatcaatgagggacagttaaatattatgaaattctctgcattagaaagaatgatagatctattaatatattaatcaacatggaaatatctaagatattgtttagggggaaaaaatcaaattttggaacacatgctaatgtttaaaacaaacccccagaaattaaaacctaaaactaaatgtgttgagataaatcagaagatttattccaaattgttaatgacagttaactttggttgaacttctgtatattaattttaataatgcaaatgtagtcatgctttacacatacacttattttttattatggaaaatttcagatgtacagaaagtaaacagagtttataatataatgaaccatgcagtacccatcaccaacctgcaaaagctatcaatattctgccatttttatttcatttatgtctatgctcattcttcaccttgactactattatattttttacagtacatttttaggtaaaattcatatatattgaaatgcacaaattatatatgtacacttttgacaaatgtatagtcgtgtaatccccatatccttatgatattgaatatttccctattcccagaaagttctctcatcttcagtcccattctgcctgcccaggttatttttgccttttctggaattttatatgaatagaatcatatagtctgcactctttttgtttcttcttttgctcagtataacctgtgtaagggttgtccatgttacagcaatgtatcaataatttttttcattgtattactaatattcctttatatgaatacaccacaatttgtttagcccttctcttattgatggacgttagctgttgtgattaaagctgttgtgacattaatgtataaatctttttgtggacatatattgtcattgctcttggataaatacctaggagtaaaatttctctttcaaaaaaccacctttcaaagttgtacgttcccactagcaaagtatgaaagttgtggttgctccatatcctttcagttgtttggttttctcagtcttttgatttctgccattttagtggataacagcacctcattgcggcttctaaaaaaaaatttttatatcgtggtaaaattgccactaccataatcataatatttgccattttaaacatttaaagtgtaagattcagtatcattaattacattcacagtgttgtgtaacagtcattactatctattcctaaaacctttttatcacttcagacagaaaggttgtatcattaagtacagagcttcctgctttccccttcccctagccaaactacagcttctaacgcagttcccacacaaactacaacttctaatgtagcttctatctctatgaatttgcctgttctagatatttcatatgattataatcatacattagttgttcttttatgtctggcttattttacctggcatggtgttttcagagtttatccatagtgtggcatgtatcggaactttattcctttttatggctgaataatactccatcccgttgtatgtatataccatattttatttattcatttatgtgttaatgtacttagaatgttcagctgttgtgacttatgctgcaggctgggatgcaagtgtctgtttgagtctgttttcagttattttggctgtatacccgggagcaaaattgctggatcataaggtcattctgtgtttaactttttaaggaaccatcaaattgttttatcagtggattttattcagcatttccctgatgactaatgatgttgaatcaggtgcttatgttactgatcttcctttgtgaagtgcttcttcaagtcttgtgcacattttaaaaatcaagctttctttttattgttgaggtttgaaagttctttttatattttaaacgcaagtcctttgttaaatacacattttgcaaatattccactctgtggcttgcctttttattaggtttatacctagaaatggaattgctggattttatggtaattctaccacttaatttttttgaagaagagccatactgttttcaagtgactgcagccttgcatatcccttgttcaccaacagtgaacaagggtttcatttttttcatatccttgccagcacttgttattttctgtttttgttgctagtagccctcctaaagggtgggagtttgtatctcatcatggtttttatttgcatttccctaatgatagtgatgataaacatctttttatatgcttgttgtctatttgtgcatcttctctagaatgatgtctatttaaattctttgcttttttaaaatctggttgttttgttgaatgctttatatattctggatattaaccccttatcagatacatgatttgcaaatattttctcttattccataggttgtctttttatgctgttaattgcattcattgatgcacatatgtttttaattttgatgtagtcccatttatttctttttgcttttgttgccttgctttttgtgtcatatccaagaaatcattgccaaatctaatgttatgaagattttccctgtgttttcttctaggggttttgtggttttaggtcttatgtttagttctttcatccactttaatttttatatagggttatgaggtaagggtccaggctcattcttttccatctggacatccatttttcccaatatcgtttgttgaaaagattgtcctttcgctgttgaatggtctggcacccttttcgaagattgtttaaccatatatgtgaagtcttatttctgggctgttttatttcactggtctatatgtctgtcttgatgccactacaacacagttttgttcattgtagctacttttgaaatcagaaagtatgagacctccagctttcattggggtaccttgaggtccatatgaattttggtggtggattttggatttttctatttgtgcagaatattccactgggatttttcttaacagtacctttcgatgagcagaagttttaaaatttgatgtaaattaatttttctaaagttttttttcttttgtggttattgcgtcttgtggtcccagaaatttcctcctatccacggaccacccgttctcacacgttttcttttaaaagctttatggattgagcttttatctttaggtctgtgatccagctctcattaatttttgtgtagggttttgaggttggggtcaaggcttatttttatgctgtggatattcagttgtttcagtgccatttattgaaaatattgtttatgaacactctcctctgtttcattgtttatccttacgccttgttactctgatcactgttttgattatagtagttttagagtaaatcttgaaatcaaatattgtcaatactccacctttattacatctttcaagattgttttggttattccacgtccttgtcatttttatgtaactttttgactcaggttttgataatattgtaaatataattttttgtaaaaaaaaagtcgtttttcatttatttgctgctactatttagaaattctgttggagagagagagaatgtgtgtgtgtgtgttgattccttaagattctcagcaaaaacaatcatgtcatttgtaaatggggacagttttacttcttttcagtctttgctttttatttcttttatatttttatttgtttttcttgcctgattgcattgactaggaccttcaacacaatgttgaatagaagtggtgaaaataaacatccttaccttattcatgatcttaaggggaaagcattcagtctgtcaccattaagaatgatattagccatacattgttggaggtatattttatcagattgaggaagttccttcccattcttattttgatgagcatttttatcataagtcagtgtcaaatatttaaatacttcttaaaaacagtgaaacttgtttccagggctttagaagtatagtgaattacagactaatttgacattgccattatcttcattacaaaatagtgttatttaattggcactctaacatgtaaagtgatacattaggagccacttccatctacacaaaattactgtgatgattctgtagaatgtggaaaaagaaaatctaatcattaccttcagtgatagcatttatgactaatgtactgagttgtgtttggagatactcctaatgcccctggccttgaaatctgaaagatttacttaacagtcaaactgttcacactcatctgcttttctctgttagattcttttactcatgtgtttattttatgttttctttggaaagatgctttaggaatgttaatatgtttttattaacctaaggagtaattcactttcaattttcctccttttaggttaatttcttttattgggtatatgctcttttctttatgtacggtgtaaataaatgaactgtagttgttaaattaaaaaaatcagaatgtatttactattggaattctttcctgctatgtttaatactagcagactagctttgaatggttcttacttttgttgttgtttttttaagaataattatcactatgggacaaggaatttttaggtcttcaacttcatttgtccttggttacccctggggttgaattggaaaaggttcagagtatttaaaagaatggttttgttgtcggtgggacagtagaatggaaaactctaaaccactagaatttggaaatcatcatgcaagaaaaaggagacccttctgtgaatcacctgtagatctcttgaaaattgcaatgggccagtccttggatccactctgctatacatggcaggcctaccaattccatgctgttcttcaactagaggtcttgcacacggtttctgtgttttttaaacgtattgctagagagttctgggttatttctgccaatgacgaaagcttttacagctttttagatggcctttcttggtccttaggcttcctagatcacccgtggtggcattatgttcattgcagcttacagtcaagtcttacttatttttaaaaaatatattggtattgtaatgtaattttttaattgaaaatagaatgttagggctaaatgataccttagaaataatatcttcatatctcttcagttgtattctaaatcactttgctgtttattgaaggaccattaggttacatttattttaagattacagggatagaagcattgattggcttcaaagataattctagtcctacactttgtgataggtgaagtgtgctcataatgtaattttgttctttatttcattagtgatgcctaacatgcccttcctgtttaccacacccagatttcattttatccctatttcacctcgaatcctcacatgcactcttgtatagaattattgctctgtttattactaagtggaatccatgttgaattttggcaggctttttccccctccatctgtgtctttgatggtagctgggtttactgccgctcacttattagtgccctgggtcttaacaaccttattcaaacaaaacatcttaaatggaggcattaaacaggtcacaacagtgagccattttgtaactttaggtgcaataaaatgggtatgttgtgttttggaatataagagctctgagtgcagctattcattttcttcatctataaaacattttagaataacagcctacatctgtttgggggtataaaattccacgttttgaagaaacaatcactgttatgtaacttcaagccagacgcggggagggagctagctttctgacgggcccacgttctgtagacgttgggaaaagtgtttgttttagctatggagctgtatttgctggcagcccatctttcacatgtgtggaacacattttcattattgtttgttcatattgtaaatgacaacatgtgtgtgatacaattttgacttgaagaatatttgaaaaattttcacacaggaatttatgagggctatttcactactagaagtcagaagcaaatttaattatttaggcatttatagcatatttaattactttagactgtcagtcttgttttagagagtaaagctggggtttactgtcgctccctttttaaactaaatacccagtggaatagtatggccattccaaatgtgtgattttaaaattatttctttaaactgaaggagcagctcaatgaataactttcattagaggaaatgggcaaaatgtttaatgatagaattcaaaatctaaagtattaagtaccaagtaagagcagataacattcagtgcaatttgtaggtgattttaattgagaaatgaatgatgccaatgggattgttagagtaaattttaaatcttttttcatcttatgaaatatttaccttcttactaatccataatcatactgtcagtcttttggggcatattttattacatattataaagtttaaaacatttagaaaagcttttagaaacctattacacagtcaagttattgttttgataattaattggaaatataatgcttgagtttcagaatggataatgtcagatgcttttatgtttttgtgacaataaaaaactctatttaactactgttatggaacttcgacattcgggggggctggctgcctgtttatgatgataacaaacttctctgagattctagcttgtcaaattagtccaggctattgacattgatcttttcttctcattgacatttccttcctgaatggtagacagattttctttctgtggtcactgtctgtcaaacttggggccatcatttgctgtagctgagtaagacagatgatgctaatctttaaatttctgattaaatataaatatttaggaaataacaataccaggccaaggtgggcggatcacctgaggtcaggagttcgagaccagcctggctaacatggtgaaaccccgtctctactaaaaatacaaaaattagccaggcgtggtggcacatacctgtaatcccaactactcgggaggctgagacaggagaattgcttgagcccaggagatggaggttgcagtgagctgagatcgtgccactgcactcccgcctgaccgacaaagcaagactctgtctcaaaaaaaaaaaagacataacaatgccctcaattcacgtgaaggtaaatacccattaattcctctgaaactgggacatttacacccacccacatgtagtgataatgataatgttcaaagtccacatttacttttcccttgcagctgggctgcctgtgcagtgccagtactgggcccgtggcgtgtgcgtgttcgtgggcatcgccaccaccagcactggtcccctgggctgtgactggacattacttcagctgctgggtggggtccactggtgttaagacatttttatcttaggaaatatgacatgggtgtcttaagtttgaatttcagaaaattaataacagattgtactgtgggtgaatttatatgcagataatttagatgtctcctggggatagtagtagttagacaagactctagagtcagattgtctgggcttcttacctcctaactgcctttaggcgttacacagcgtctttgaacctcagtctcatcaactataaaatgaaggaagtaatactccctaactgtctcagcatgtgttgtgaggattcagtgaaataaagcttacaaagtgcatatttgcagagtacctggcacatgagaagtgttgatagttctagcccttactgttagacagctcatcgtaaatacctaactctaagtgtggtgattctcttgaccactcatacttcattactacgcatgactctcctccctagctgtgcctgggacgtgatcagtgctcagacccacgtccccctgtgttttgttagaccctctccactcccctagcattgactgatttggtgattcttccttgaagggtgcgagcttcccactggctgctctgttcctggagacctgtttctcaagtttgactcttgcaagtagctctgtctgcttcctctttcttccttgcctcttttttccctccacctgcccttgccctctctccagtctcctccctcctcttttctccctctcctttccttctctgccccgtcttctgtcttctgtcctcctcctctctgcccccctaccctctacctccctgctttctttcccctccttcctgcttccttttttacccatctcttttcctctctccactttctttccttttcttccactcctttctctctccccttctcttcctgctccctctctctgctctgttgtctccccattcccctaacacttctctcccaccaccccttaccttccttctctctcctctgtgtttctcctttaaatcctaacactgcctgctaaggagtagacagccttggctcttaagcacagaaatgtcacgtcctaaagtgtttttattatgctgggaaatatttattttgtcatttcagtagccagactattgtgcttctgtttccatttcaaaggggattcacaacatcattttatgtcccttgggctcaaaaactcagaagatcaccaggctcagtggctcacgcctgtaatcccagcacttttggaggccaagtcaggtggattgcttgagccctcaagtttgagaccaacctgggcaacatggtgaaaccccatctctaaagaaaatatacaaaaattagctgggtgtggtggcgtgtgcctgtagtcccagctactctgatggctgaggtgggaaaatctcgtgagcctgggaggtcgagggtggtgatctgtcagcctgagtgacagagcgagacttcctcccaacaaaaaatgaaaatctacaggccacagtttaactctttttctaaacattatgtctactataactgtgaatttgtttgatattagctttgttataaagttgaaataatatttacaggctcgtatagtcatacaggcaaacttggctcttttttgcctaatttatttaattttttttttctctcttcagattcctttttctttggtccagtttcccttatgggagtccttaaaagtaagtttctcagtcttcacataaaatttgtctctaattataacatacctaatagtttgagtgtggaagagtagaacataatgttgactagaagttcagcaactcaaacctattagcagttgaaaatatattttatgtgtgatttacatgccatttcagccttttaaacttgttcaggtggctgtgctcctaggaaataggcatagcaggtggcactgaaatccacagataataagaaaaaacttaggtttacttttttccatattgccattctttctccaccgttaaatttcattttgctgtgtgcgtgtgtgtgtgtgtgtgtgtgtgtgtgtgtgtgtgtgtgtgtgtgtttagaagttaaagactaacagtgagggtaaatggaagaggaaaaatgcaaagccttgaatacttgaagactgagaaggaccagctcccctagcaccctgtgtaaggaccacttggatggggagcagcagggtcttagggctctgactgtcccttccgtcttggttgctcactccagccaggactaggagcctccagagggaaggagcagagtgtggtgagttgtcagacaaccttggggaaggtcagtgagctatttaaaaaaaaaacaacatgttttaaccattaaggacatggacatgggcaaatatttcatgacgaaaacatcaaaagcaattgcaacaaaagccaaaattgacaaatgggatctaattaaactaaagagcttctgcacagcaaaagaaactatcatcagagcgttcagactacctacagaacgggaggaaatttttgcaacctattcatctgacaaaggtctaatatccagagtccacaaggaactgaaatgaatttacaagaaaaaaacaaagaatcccattaaaaagtgagcgaaggacatgaacagacacttctcaagagaagactttcatgcaggcaacaaacatatgagaaaaagctcaacatcactgattattagagaaatgcaaatcaaaaccacaatgagataccgtctcacaccagtcacaatggcgattattaaaaagtcaagaaacaacagatgctggtgaggctttggagaaaaaggaacgcttttacactgttggtgggaatgtaaattagttcaaccattgtggaagacagtgtggcgatttctcaaagacgtagaaccagaaataccatttgacccagcaatcccattactgggtatatacccaaaggaatataaatcattctgttataaagatacatacatacatatattcattgcagcactatttataatagcaaagacatggaatcaacccaaatgcccatcaatgatagactgcataaagaaaatgtggtacatacacaccacggaatactatgcagccataaaaaggaaatgagattatgttctttgtagggacatggatggagctggaagccattatcctcagcaaactaatgcaggaacagaaaagcaaacactgcatgttctcacttataagtgggagctgagcaaggagaatacatggacacagaagaacaacacacaatgactggggcctgttgtggggtgcagggggaaggagagcatcaggaaaaatagctaacacatgctgggcttaatacttagctgatgggttgatacatgcaacaaaccaccatgggtcacatttacctgtgtaacaaacttgcacatcctgcacacataccctggaacttcaacaacaacaacaacaacagcaaaagacattttaaaaagcctacattcaaaacatgcagagatgttacattggtttttcactttctggtgcagtgatactgaaaactgtgggccatgatataaattgtgtgggtctttgtcagcattttaaagaccataatcaagaagaatatagtagagggcatcttacgtggtaagagtaagtcttattttgtaagacctcaatgaatgttatgcatgcgtgcacacacatatgtatctaggttgcaatgtaaaatgtatttctcgctgtggataatggtccaaaaactttgaaagcccttgttctagtgaaaatggttcataaatgaccaggctataaaataatctaggtaggcattagctaatacaaaaataaaggagttactctcataattttatagattgactagtcatggagtgctcatacaaaatgcattttgaagagtatcataaaaattatttgtacttggaaataaattgttgaggtatatactaaaggatactaaattgagaaaaaacattactcattaacaaagtaaattatgagatgttaagtatcaagaagtatttcttataagtgatctgattttaaggcgtagtattgctcatttaatatagttttttggctcttttgttgtcttgtttgtttgttttactgtttcctatgtggtgcgtggtgaaaatagagttctctggcagtgtttcagggcatgatgtaacagctatccaatgagaaggtcacgttccattagtataacagctctcctttttagtgtgtgacaaaagaacaatgaagccaacagctgtccagcaaacaagacttactttattagtgtctcaataaccagcattcacacagtttctgcacactctaacatccttatgccctaattctgcaaaggaatgttttgaggcctaaagaaggaaaaagcatagtgtttatttcttttcaatattaaggacatttgtagaattctagctagttaagaaatgtccagaatttttcagagtaatcatagatgacaatgctaagatttaaaaattctctttgagcaaatgttaagatgctgccatttttttttctgtcaagtcgtttcttgaggaacgctttacatatgataaaactcaccctttatacctgtacatttttgtgagtttcaataaatgtttataaccaccaccaaatttccatcaacccagaaagttccctcatgccgtcagtgccctttctgtacccacagcccctgtgagccactgttctgtagtcttctcttttccagaacatcatagaaatagatacagggtactattataccatcttgtgctttgcttttttttttacttaatgtaatatttttgagatgctttcctgttgttgcttgtaccagtagtttgttttattactttgtagtattccatatgtgtatggatatgctacaatttattcactagtttatatacattgagttgttttccagtttttgatgattataaataaagctgtcgtaagtatttgcatatagtattggtatggatgtaggtttttacttctctagggtcagaggccaggagtagcatccctgggtcatacagaaggtgtatgtttaattttataagaaacaaactgtcaaggtgttttccaaagtggctgtaccagtttgcattcccaccaacagtgtatgagagttctagttgctctacatccatgtcatttcttgttactattaggttaaattttttttccagccattctagtacttgtgaattggtgtctcattggggttttaatttctagttccctcatgactaaataatgttgagcatcttttcatataatactgttttttaaacatctgaacgtacaatcacagtgcttttgtagaagtagacagtttttggaacttttttatttttgtgtttacaattttatctatttaaacttgagtttgcagctatagaaggagattgtattatatgaaaggatttctccactgtgtttatttgtgtttatgtgggaataccattcaggaaaatttttcttagccaagactagcagattgcatcacatggcactgcagggagtaaggggctggaggtggtggtggccactgttaccttaaattcaactctgtctaaaagtcatcatctttcttgtaaaatcatgtcttcctgctgtctcccatttctgttaatcagtattctcctggccacctggtctcaagtctcagattaaaatttgattcccttcttgctctttctctatatcacattactcaacaaattttgttgacttcactgttgggaatttgtggccacatttcacctgattcttagtaccttatgttttcccacatcctaataggctctcttcttatccattctacattttggatgtgtctgatcttccttaaacttttctttcagtaacacttaggttctcaggaacatataactttctaaaactctaaaacattaagttcttggcattcaagtttctcaacaccctgtccttgactggttttttcagcttctgccctatactctgtgtgtgtgtgtgtgtgtgtgagcgcgcgcgtgcgcgcacacccacacgcacacacaaaattcttcccctccagccagaatagcctccttactgcctctaaatatgttctccccttctctgttctctgactcctttctgaagtatgcttccaaggatccaaaagtgatgcatcactcaaatctcaattcagtgtttgatctcctgcttgaagtcttctaatgaaggccttgaagaattgcccttaccacagatttgtctgtgtcactgactcgtatttaatcacccaccatattgtgtttaaaacatcttatagtgttcagataaggccttaaccccttcaatttacaagtaaatgatacctgctgtcattgcagctctggtgcctgtctactctgagctggatatggttgcatgtcacaagaatgcaaagatgaataagaaatggcttaatgcccttgaggagctgagagtccgtcagagtggcacccaactcgttgataacttaaatgtaatgtgtctcttattgcagaatacttgctccccaaatcctgttactgtgctacatcatttcctttgtttttcttttctttattatacatatgcttacaaaagtatgttttagatgaaagaggacaagacaccataaagagatggggaagcaaaagcggtagattatcatatccaaagtcttagagaagataattttccttgaagatttatatttactttggaactttctggcagcccaacaagaagagaagcatgatagatttcatggtttttattatctgacaaagacctgtagcttgctattctatcttatcctttgactttggataccatctttataccaacttgcatgtttatagctccatggcaagccccttcctctgagtggcagcctcagatcaccagctgcctagttgacatcctcactcaggatgtctctgagtggctaggtcagaacagaactgtcagtttttatttgtcttcttcccaatctgttccttcctagttggtccacttctcagtaaatagcaaagttgtcttatgcttgctcaaatagaaacttaagaatgattccagagttgtattcttttatccttcatcatctagcccatcaacaagttcactgttctagttcaagcctctaacaccccttgtttgaattgctacactggcctctccagtggtctccctcatttcactcaggctttcccaaaatatcttcttcacacagcagccagagtgatcttttaaagaaatgaattaggtcaggcacagtggctcatgcctgtaatcccagcactttgagaggcataggctggaagatcacctgagctcaggagtttgagaccagcctgggcaacatagactccatctctacaaaaattaaaaaaaaaaattatctgggattggtggtgcatacctgtagtcccaactatgtgggaggctgaggtgggagacttacttgagctcacaacctgggcgacagagtgagaccctgtctcttaaaaaaataagaaaaagaaattagaccatactattccttgctaaaacctgtcagtggcatctcgttaaaagaaaaataaacccagagcttaagctctggctggcaaggcactctgtaatctggcctctgtctgcctcagccttatcccgtgccactcacccgctgtgcccggccacgttgcgctgactgtgctgctgcctagcgcctcccctcgttttttgttttttgttttttgtttttttttttgagatgtaccaaggcctttacatttgtagatctccctgctagaaatattctttcttccttcattctatatacatcattttttatgtgtgataatttttttaattttgatttttttcatatttttgaaaattgacaaataatatctgtatatttaaggtgtgcagcatgatgttttgaaatatataaatagtgtatatgtcattaccgagtgtctattacgtgccaggcattttccagggtctggggatacagtgatgaagaggactgacacaactgaccccatggagcattcattccagctctttccctaggcctctctccatcccccttccccatacctctctcatgtctcctctttccccattactcaggccttagatcacatgtcacctcagagagacgttcccggtctacccctctccaaagtaggactttcccctcctccctcctctgtaatcataacacctatttatttccgtactggtattttaataaattagtttatttagttatgcacttacatcattggaataattatttacgacatcagtggtgtgatgagcagacactgtgtgccaggctctgggttaagcacgatgcatttgttactgtcttcttcacaccacagacaacccagagaggtgggccttgttgttatccccaccttaaaaccagggaagcagggctcaataaggttgtctttcacctagttgcctgagcaccttttactgtgtgctgcgtagcagacaggtgactcaggttaccaggtgattttttagtgatgataacaaccataataaaagcaagaacagccaacatttttcaaagctacagtgtgccaggcactgtagtaacacttcccacacatctcctgttcatcttcatgacagtcctgtgaagtaggtgctggcctggtctttgttctgtagatgtgaaaatggaaggagagtttgaacgccttgcccaaggccatgggagtactaaggagtacagccaggatttgaactcaggttcagatctaactccagacttgatattcttaatcacgttacatgtaattatgcacaccgcacatgatgtgtttcataacgtttttgtattgtcgtatactcaaaagttgataaaaagttgaggtcatatttagtcagctcattgaaggcatttctgtaaattgcattgattccttaatgatgacatgtagcttaggaaagcctggccagcatatttcttagaccacctctccccagtatccgttgaatctgctgagcttgggcaaggattaaactgtgctcacttgagtcagttctcagagaccaaccctggagagcacagataagttcacagttaatgagttcagccagaaccgaattttccacgtgcttgtgtttaactccccacaggacggtgcttactggaggaagaaactatgtcttctgtttattctttatggttctgtcttttacacagcaggtgtttatgtaactatttgctaattgtttgaaggttagcattctttttcaagttgaatgcaaagttggataactgtatctacgttaactgttttatttgtacattcttttaaaggtatgttcacagctataaagagttttccctttttaaccatacagatcttttcttatcaagctttaagtcaaaagtaagcatattatgaaaggatatgataaaatttcctgtgagaatgcatttttttttttttctattttcttagtgtgagacatcagtttatattgcagtgtggagaactgttaagaatactgtcaggtccgagtggttttgcttacagctacagggtgttacaaagcaatagctagatgagatgtaatctttaagctaagcagtatttaaagcaaaatgaaaataaaatcagtttggttttgtaagacagcaacattatgctaatacttttctaagatgaaatcatagctttgtcatagaaatcagggaccaatgcattatcacttcacttatatcaatagttcaatgtatataataattacttagatctctcttttatgttttataagtattttaaacgtgcagtactacataaaagctatgttttcaagttcaagaataaatagcattttttcttgttgattcttgttttaatagtagttaaaatgtctaccaccaccctacccacaacaaatttctctgatacttttagtaatataaacaagaattagaagaggctcagtgctcagggtctgcagttataccatttcatgagactgggagaatctggtgtcggggaggaacccagtgggaggggattgaattatgggggcagatctttccagcactgttctcatgacagtgaatgagtctcacaagatctgatagctttaaaaaacaagagtttgcctgcacaaggtctctctctgcctgccgccatccacataaaatgtgacttgctcctccttgccttctgccataattgtgaggcctccccagccatatgaaactgtaagtccaattaaacctctttcttttgtacattgcccagtcttgagtatgtcttcatcagcgatgtgaaaatggactaatacaactaataagaaccacagatagaaagctcatagaacccccagtcagaataaatatccccccacatatctaaaatctagcccagtcagttccaaaaatatcactgtataaactctaaaacctaaatattactaagcaaacccagcattttagtccatcttgcttttgcttaagaataatcaatgtctttgcctgtaattaccagcacaatcattagttcaagattttcttataaattcttaatatctttaccgacttatctagaatgcaaatatctaaatatctcaaccagccaacatatattattgcccaaaacaaggtacacatcaacgcatataaaattgatgctgcttgcacatcccagaacagtttcagtctagctgcctttataacccaagtcagcctgtataccataagggattcctaattatcagttaggtatatccatttttaattatgaaaagtagtgctatatgaaaaattcattttagccttttagccactagctcgtattgcaagagctatggtgtggcggaatgaaagccaaattgtggttcccagttatgtttgatactgttttcagtttcagaacttgctatcagaaatctcttttgtagacatagtagtatgtgagtacttcacagagagatggttcatctgattgaatgataaaattataggcagctgttgctttgtttttaaaaatatatgtgcaaaagctacacaatagcttgatcaactacagtatggaaagtatgtgcacgaaaatcattgtctcctgtctttaatctgttataaacttctggtggtaaactcacagcagtgagacctacccagaggatgatatcaagagcaagcctaggtttgaaaaaactaagcattatcctttccattatcttaaattttgtcatgtgatgttactaatttggaattgagtagatgattctgtgcacatacttattttactacatgtataaaaagcatatagtaaaatatcatcatcttgtagggttggaagccatataactgcttttgaatagagcagctaaagaagtcccaagttgtaagtatttgttcactggagccaaaacagttattttcagtgtgttattcataagacagtagtgcttatttgggtgggtcttttaaaagtgaaaaacaaagccttctcttcaggctatactttaaatagaagacacttggtctggggttggactcccagccacttcatagtattgtgcctggtgttggctttctggcctatgactactggtgctaatagctattatcttggggtgggggtcggggagccaaactacttcatgctattcttcctctgataggcctttagcattaagtgaagaatcacttgggaaattacaacctgattgtttttgtagtggtatcactgagtatcctaaagaataatacaaatactgttaatgtaaaaagtcaagctgatgtttaaaaattgcttacttttaaacaatagttattatggtgaaactcaactagggtctgtagcttagttaatagtgttgtaccaatctcagtcttgtgctttgatcattatactatggaagctgggtgaaggatatgtgggaactttattattattattttttgagatagggtcttgctctgtcacccaggctggattgcagtggtgtgatcgctgataactgcagcttcaacctcccaggctcaagcaatcctgctgcctcagcctccctagtagctgggactcaggggtgtgccaacacgtctggctaatttttaaatttttttgtagagacagggtctccctgtgttgctcaggctggtctcaaactcctgggctcaagtgatcctcccacctcagactccagcaagtgctaggattataggcacgagccgctgcactcggtggaatgttcctatttttgtaactcttctgtaaatctaaaattatttcaaaataagtgtcatacaacctagtagacatggtttctaatcaacctgtattaaggaagctttacttaagaaaaattaccgaagtgaaactaagaacatttttgacttctgttctcattacttaaacttgatatttctcattaatgtaaccatagattcatgtgaaaatttcatttatactgtaattccagctacttgggaggctggggtgggaggatcacttgagatcaggagtttgagactaccctgggcaaacatagcaagatgctgcctcaaaaaaataaaataaattagccgggcatgatggcccttgcccatagtcccagttactcaggaggctgaggcgggaagatcgcttgagtgcagaagttggaggctgcagtgggctgtgatcacttcactgcactccagcctgggtaacagaacaagatcctgtctcttaagttacttacatttgaacagaaaaaggaaatgggacattgaattgggataaataagcaaacatcagggaaaatgtggccccttgctttttaaattccttattgttattttggtatacagcctcctccgtgagttgagactccaatactgcttcttcacattcgggccccttaatgcccctctcctcccctaatcatttatccgccttgacagaaatgatcattagacctctgtggcaatgaaattacttatttaggttgagaaattatggaaatttagaaaattttcggcagattcttaaaaaaaaaaaacttttgtaaacccacattatttaaattcattgtattaacttcaaaatatttaataacgtgtgtattatgatgtagttcgactagaagttgagctgtatatgatagtgaggaaacagactgctatttgcaggacgaaccagcctcagttttcccatttactatctatgtgacctcaggcaaatctcctagaacttgcccctcacctgtttttgtggagaataatatacttctcaacattgaatgagattatacatgtaaaatctttagcatagtgcctagagcattgtaggtagtcagtaaatcccaactaatattgtcaatagtaataatttatattgttacctgtactatatcctacattccagtctaaaattatgtgaatgtcataatcaatacatagtcttcctgtgagtaatgtcttccagctagagtattttgtttattacaattctgttgtccctccaaatagatgagcaaatatgtaatttcaaaatatttccataatttatgtattttttacgagtcactttctgattattgttgttttatgagtttaaggttgcactcaaatgaataatttgtaaataacactctttttagattggtctcaatattacatttctgaagttctgtattcagacaattcctcatttagaaaaatcatttcaaactcatttaagcaagttgttgcagacattgacatagtttgttcattcacttggatattttaagtcattccggtagaaattgtgatttgcgtgtggaagtaaagtgtctcatgaatgcttatctgtgtgttaccaggacaactatatcctatagatccaaacccatgtgttttcatgcccacaccagagtgtcccatccagatcccagctttcctactcgctgtttaatctgtgagttacttaacatctttgagcctcatctttagacaatttttttcttagagatgggatctcactgtgttaactaggctagtctcaaactcttggcctcaagtgatcctcccatccgggcctcccaaagtgctagaattacaggcgtgagccacaatgtttttgtctataaaatgacaagataataaaaattacatgtaagtcggaagattctggagagaattacatgagctgatgtatgtaaagtgcttcacacctggaatgtgggaagttctgtatgttctatggaagtgtgtattgtggttgctgttacagtcattctttacgtcatgctttgtgtttgccactgaagtttctcactttaaacgttttgggtcttctagagattttttgtttgttttaagatatttattagtatccatgtcaaataccaaattatttctttatgtgttttttgtaggctcattattctggccaggtgatagtggaaagttagacttatctgtggagattctgtttttaaatgttgtcttcagccatctgagtctatttggattgtgttttttcgccccctggcaaccaatttttttctccctagattataacaggcacctctgtgaagctttctctgtcacctcacttctctcttgtataatcctcttctgcccccaccataccttcatcaaatattagacctagggactgttactttttcttttcttgactacaatacctgacacctagtaagtagttgttgaatttatgacttgcataacatttttgatttcttatcacattcacatcttactgttatttacttttgcttataaactcagcattattaccagcatttcaagtctatttggagtagccttctactctttggaacatttaaagatataagtagattaactgaaagtgacctttagtcatcaacagaaatctagtttatattttgcattgcttttctactaagttggtgaagtaaatgttggtgttaaaactggcattagcctgataaaatacaccctttgccaccttaaaagtaaagaaaaagcgattccattgtcttgtttcttattctttctgcagtgcttctaggagctctggaaaaaataatggtttctattaaagcatacagatgtatttgcaaacattagagcattttctgaaaatataccagatactctgtttaatggcaatattatctttagaaaccagtctctaataagtcttttcttttttagcttatctgctttcacaagtaaggtgataaatacctatttgatagctgcactctcagtgcagtaaattgaattaatacactttcagagaatcattcacgttagtatggatagagggaaatgttggtcctcaaaccacacgctgtcacatatttaatttgttagatagttaacatagtagctgtctgacttaagagaagttgtgaaagttgacagagtaaacagagtcttgtacctaatgaatttctatggcatcttcttcatcccctcagtgaccctcacaaccttccagagatagttgtcagtggagaagcattcagagtaggaaattaaaatgaactttgctgttcttcttttagttgctgtgtatttgattatccctaaaaatgtcagaccactctcagaaagtcattatacttttctaaccatttaaattaatatattaaagaggtcttttttgttaatatttgtggtcactattgcaatgcataccattattctgaaggtcctactcaattcagtaaggcaaaaatgaaaataaacaataaaagttaccttaattggagaggaagaagtacaactgtctttattcacagatgatacggtcatctatgtcgaaaatttgatgagctttataaaaaaaaagctatgaggttggtaactttagcaaggctgcagaatacaagatcagtgtacaaaaatcaattgtgttgataaccagtttcagtttctgcatattagcaatgaacaaccagagactgaaatttaaaaaacagtgcgatttgcagtagcatcaaaacatgtgaactacttaaggataaatttgacaaaaccagtgcaagacctgtatactgaaaactaagacagtgtggagagaaacaaaagaaggccttagtcaaatggagagggatgccatgcctgtgagaagaaaacccctcaacattaacaactggttctctccaaaataatccatgggtttggtgcctcccaatcacagtcttagcaggttatttcgtaggaattgataatcagattgcaaaattcatatggaaatgcaaaatatttagaataggtagaaggactttgaaaaagaatttggaagacaaatactacctggtttcaagattcattataaagttacagtagtgaagaaagtatggaattgatatcaagataggcctatagatgagaacataatagagagttcagaaatagacccacacatatgtggacaattgatttttgacaaaagcaagagggcagttcattggagaaatgattatctttcccagtcactggaacaactgaatatccatatgtgaaaacaaaaccaaataacttcaatctacatattgtaccatatataaaaattaactcaaaatggatgatagatacaaatgtaaaacctgaaagcataaaatttctagaagaaaacacaggatcaaaaaatctttgtgactttgagttaggcaaagatttcttagatgtgacaccaaaagcaagatctgtaaaagaataatttggacttcatcaaaattaaaaacttcggttctttgaaagatgctgttaaaagaatgatgaaagatgttgttaaaagaatgaaaaggcaagactagaagaaaacatctgtaagtgagctatgtctagaatatgtaaagaactcttaaaatgcagtcattgagatacggtaacccagtacaaatgtgcaacatatttgaacagacacttcaccaaagacagtatgttgtggatggcagataagtacatgaaaagcaactcaacatcattagggaaatacaaattaaaaccacaatgaaggcacggtggctcacacctgtaatcccagcactttgagaggctgaggcgggtggatcgcttgaggtcaggagttcgacaccagcctggccaacatggtgaaaccccgtgtctaggactaaaaatacaaaaattagccgggcgtgttggcaggcgcctgtagtcgcagctactcaggaggctgaggcaggagaatcatatgaacccaggagctggaggttgcagtgagccaagattgcaccactgtactccagcactccagcctgggtgacagagcgagtctgtctcaaaaaaaaagaagaaagaaagaaagaaatactgcaacacacttgctagaatgattaaaattttaaaatggtgatgataacaagtattgggaaagatgtggagaaaccagaactcaagggaatgtaaaatggtacaatcgctttggaaaacagtttggcagttcttaaaaagttaaacatataactcccatgtgatctagtgatttcaccgctaggtatttccccaagagaaatgaaagcatgtatacatataaagacctgtatacaaatgttcatggtggctttatttgtaatagccccaaactggaaaaatcccaaatgtccatcaacaggtaaatgcgtaaatcacggtatatccatacaacagaatattactaatgaagaagaaggcaactgttgatatctgcatgacgtgggtgaatcacgaaataattctgaataaaagaagttggatttaaaaaaaatatgtgattacaatgatataacattctgggaaaggcatactaatctagaatgacagatcagattgcttgggggatagtgaggaaggacaggaaggaggggttacatagggatacaagaaaacttgtgggtcatgagtcagttcactatctgaattgtggcgatgatgttttgtgtgcgtgcacacacacatatgtattctctgaaaattgtttactttgagcactctaatgtagctgtcactctcatttctgtgacttattttagaaagctgttaagtctttgggaaagtcacttatgtcatcagtaaagaatgccaccaaaatagcttctcacttaagttcccatccccagagctaacccacaggaggttccgataaattcaaatatttaataacttgtatttttctttctccttaaacacaggccctctggtcctggaggcaggatcatgtggtggattcttggcagtcagcagtctgtggagcttttgcaggtgcaaaggattatattatactgggaaagaccaaagagggggaaaaatgtgaaaatattaactatgcaaaaacaacattctttagacattccaggttgtttagatgaagagcgctccactagttgtttgagaaaagaacgtgtcttagaggggaaaaaaaaaaaaaaactgctaaaaaggtgtctgcctgaaagacaaccaatttgtttttgacaaatttttctttttctttttatctttattaaagccttcactcaggccctggaattaccttaaagatgatttataaagtcctctgtgggaagagacttgctgtgggtgcagggctcaccatgcagctgtctgccttgggcagtgcttagggggtttaagcgatttctgcagaaggccatgattcacggtttgtgtgacatgtttgacagcactgtagattaactagtgtcaggagagcagaggctcctccataacttactgaagggtaaactgttctgtgtaggaagtatggagatctacacatctgggcattttcgagacattaaagcaagagcgaggtgacaatatgcaataccgtgttatccatcactaagtcatatgaattttcaagtgaggctttaacgagaactcaaatgctttaaagagcttaataagtgatatgtttaaaagcctaagagagaagtatattttgttgttacaacgttaaattagaattatagttgaaatacaatggaaatttgccagaaaaggaaacttttagttgagatgtgaagccagtaggggaggtttagggtgttaactttattggaaaataattattttgcaatttgtttaatggtcatttttgttgttgttgtcgtgattgagaaaacaaaatgttcattttatagtactctttattaatagactcatttgacttgtagaattgataatcaacaataagaattttgcctgtagacatgaaaccaatccagattgattatgatgatgatcgtttccacatgacacatagtcattagctgtgttaaataagtaggtggtcttgattcattttccagaggtcaggagtcattattccccagtccctaagagagatgtgcatttttgtagacactctcctgggccctggggacaaaatgagcgcattatggaaattaagtcatcctggataagtaaggctactttttaaagttagcaatactataaaacttccatgtgttgaaataagaacatattctctggtcctattccttgaatacccaattcaaagatttgcttgcagagacattgttactattaaggaaatttgcattaattacagtttccttttcagaataatactctgtaatagacactaagcacttgtactgtcagaaggagtgagagaagggaacttcctatcagacatcctctatctatgtggtaggatcctaccatccaggccctttcagttaaggtgactcacctggggagtgtggcagcacagccggtgctccagtgatgctggggtatggagaaagggagcgaggtgcccacggctacacatctagcacaggctgagctgtgtgacttacaggattctgaagtctctttttgctccccaactcaggaatgagactttgggaccctcctgagtgccagtttccttacctgtaatgtagaagcaacaattcctaccttaggggattacttcagggcttgagataatgtatggtcagtactctgtactctgcaaaaccgagtcgatgtaaggaattactactatttcaataagaacaactaacatccagaaaatgaaaacctactttcacagtaattcatcttcttgattgagtgaaggaatgtcatatcaataaagttactgtacacaacagtctcctctaatagctcgtaaattttaaaatgcctccaatataagcatcttatttttttctgctgaagttctgataagtgaaggagtttgtccaaggcctgcaaaaaatctgttgtcagtagaaccacatatatttagcaaaagataaatagattgcttatttatatcccttattttgaaattttatttggtacaactgttgatccagaggaggttactattttaaggcatttctgaaggataaacatcacttgaaaatattcccatttgtgaaaaagtgagattctgtaagagttgcaacatggtgccttacagcatatagagatgaaggatgtcttgtgaagtccctttaaaatacacgctgcacttgcagactttacccttacatggccataaaagcagtgatgaaacttgccctcaaatcagaaatcagatttctcatccccatgtgcttttccaagtttaaattggctaaatcattgcagatgaaccattctgtgtgccatccttggcactctttcttgttcatgcttgttttgtaaactacttggcgcaaatatccaaaaatgtcccgtgatcttggaggtgttgatggcttgtcatgcacagaaattcccttggcttctggtcggggtgaaactagggggataaaaggactttgcaacttccttgcttcgagttaacttctaaacataaaccataatgcagcctaagtaattatgacatttgctactatagtggtatttggtactctagtatattttgattagtttctcataataaacacctctgtacattctctaggagagaagagggtgggggagaaagaggcagggaaagagacattgattgcgatctctccatgggtttgaaattcgagaacagggtgagggattatttgggtaacaaatgagaaggcctgacacaatctctattaaaatacaaacaaaaaacactttccttcttgttgatggggaagtcttccacatctgcacacttcactggaggtcacgcacataagaggggtatggtggtgctcttctcccttccagactaatcaggggcaacgtagggtctggaggagcaatgaatggcagcaaggttgcccaggggtgggttcgggcacttccccactgctgcccccacattctcagccactgcttagaggtgacagctccagccttattgtaggaaggtggctactttgtctttatgggtgttggggcaggggcagttagggaatctgcatttgttccccaaggaaataggagataatagttttatcataaaattttagtttctcctgaatcctgtcctcgaaagcagttagcctaacattcagtacaaacctaactccagtggagaccatagaaaactgtttcacagatgctttgaacacaaaagcagcctgtaattgctgtaccaaataattatttcctgtctcatatgttagactgttccttgtatttattaccagtagcttacagtgcccttaaataaaacgtagaaaataactacattttaactgaaagtcctggcccccagcccttccccgttatgaccattattctattctattatcttcacaagtcctccttacagccttacaaaagcattgtgaggtctgtgaattagagaaatctttgatagttgaagacaggcaaattggtctattagtaacacataaaatacaacttctctcatggtagtaaagttaggacctattgaagcatacatgtttctgtctgtaacttttcttcatattactttcatgaaacctaaatctccaagagaatattggtaggcatccccactaaaggaatggtaaatctttgctaatggccaaaataagtttgatttgcagtaactaaatttattagatgttccttatcaacctttaggtctttttaattggtttaggatcgtttgtgaacattttcacatacgaaagtgggtttaacaattggacaaattttaatttgtcttatatatcaaagtcattatgtagtggaacgagcattacttttggagtcatcatacatgtgacagtcccaggtcccgcaccagctgtgtggcctgggcaagtaagttggttgtaaaatgagaatagtaacacctatgcaaatgagatcaaataatcaatgaaagtgcctagtgcattcctggcatgccagatacgaagtaagcactgcagatattagctcctacctttacctttccctgccttttagaggatgagttgaaattttcagtttataaaaactatagaccagggtaccgattaagcgttttcgagtgcctgctgtgagtgtgctggtctaaagatacgaagaaaaagcactcattagctctggccaccaaggaaagagttaattattttgtgattactgctgtgagccagatgctgttccaaacatgttgcgtaggcccatttaattcctgtgtcatactactatctgcattttacagatcagaaaactgaggccactaggagaccagtgggtaagagtcccagttccagagtcagtacaggctttagatcccgtctcagctctgcactaagtaaaatcttcaagtttttagcctccataagcctcagtttcctcacctgtagcatggggatgtaagagttcctagctcataaggtacttcagccacagaataagtaattacctaaggctagacacctggtagaactgggatttaagcgttggtctttccaactccaaagaagggttctttcaggctagaccgtgctgctggtaagggaaacaaaaccaaatctgttattttggtgtatgggaagtttgggatagtaaagtttgttgcctttgtgtcttgtgtcttttttccttttcttcctttcttgggggagatagatagatagacagacagacagacagacagacacagagagagagagagagagagagagacagatagtgttcatggatcctgttatgtaactaaaagtatatttacttttccagggcagaatatatggttaaaagagtaggatttcaagaccaagtccacaaaaatttaaaagacacaaagcttagcaagtctctgaatttcagacaacctctggataggagatgaagagttttacatagtcataatttgaaatggctaaacccaaggggattcaaatattcatgtcagttgatagtattacccctaaggtgtgtgacattcaggggtaaccagaaatggaccatgagggcataaataggtacacctttcaaaaagtcagtgtcataatcagtgttaccatatggaggaggcttggtataatcttatttcagcatcataattagatatttggcagagatcagatgaccttcttgtccacaagccacaaaagcgagaaggaaagtagtgctatttctggagtatccttcacacacgggtgtcctgttgcccttataacactgcctctttacccctagctcatggaagctgaatctttgtaatgccttttaggatttttattatttctgtctctgtagggcctcttcggatttagaatatatctttgtactgcattttaaatgtaatattgacaccataaacttggtttatgttaaaacagaaagtccttcaaaaagtccaatctgtgtacagttcagccatcacgacattcagataacgcaaacatgagagagaaggttaggaaggaagccataatgtggaatgtgtgctgaagcgagactcaggctaagaagatgtagaagagagcttagaaaggtaactttgactagcctgctgtcaggagcccgtgaaacacaaaaagctttgctcctttaattcaaagaatccagccatgtatacccaaaatccccacaatgtcacatgtgagtctgtttgtccattttgctatatgcaaaacagaaatgatagacgcattttggagtcactttaaagaacagtggtccaggctgggcgtggtggttcatgcctgtaatcccaacactttgggaggccgaggcaggaggagtgcttgatgcaaggagttcaagaccaggctgggcaacagagcaagaccctgtctctatagaaaatttaaaaattagccaagcatggtggtgcgcagctgtagtcccagctactcaggaggaggctaaggtggagagatcacttgagcctaggagggtgaggctgcagtgagttatgatcacaccactgcactccagtcttggtgagacacagtgagaccctgtcttttcaaaaaaaaaaaaaaaaaacaaaaacaaaaaaaaaaaacaaaagacagtggcctatagaaagtcatgaaccctttgagaaccattaggagcagtgtgtctcacatattgagagtgggcatctggccacatacatgtatgtcatgtgtacacattcatcatgtatgtaaacatacacactcattagtttgctagttaatgaaagagcaagataaattgtggagccttgtatttttcacctgagtgggtagagcattttcttctctcatgcagttctgtatcgctgcaaaagaaatgaagcgtgtggataaagattgtgcatgtgtgcatcctgttcttcaatcagccaggtgtacataatgacgaagtgatttgggcagagtcaggaattctaaaaattacaaaattatacagtaaacaggatctcacttgggtgttgggtattatttgtacaggtggatttgccgctgcagtcaccacccctctagacgtggcaaagacaagaattacgctggcaaaggtaagtggtgaaataatgtaatggagatacttcagatgctcatatctgttagcactaggactacaggtgtataaagtgaacacaaatggctaccatttacctgtaatagcatcttatgctgcctgtgcaacctctaacaaaactgccattgatggaacaatgtccccagtgtctacataatattgtaccatttcacagtcattttcacatagggctggtagagccactgcctggcagtaccatcttcaaataaactctgtttttactggtgacaaacctaagggtcagagaggttgacgagcctcctgctatgtggcaggtaagtgacaggctttgaacctagggtcatggttggccttaactggatgggttaagacagttgtcagaaatgttgaaaccattttgtttaagagaaaaattgttttaaaaaaccctgctagatagagagttgaaagaatgccatacgtataacatacctgaactgaaccaaaacaaaaaagtcctatctttgtggaaaagtagaacaaataatgggccaaattttagtatggaggtggcaggatccaacctaagaatgttaatcacgttttaaatggaacatttaaacggcactctattaaatatgcttattagctgcttatgcaggtttcatagttgtaccatttacactaatgattccccgccctcctcacattgcttcatagtgcttctgtctttctgctgttaaatagttcatcagtcatctcgtgagctctgataagcagccacctgtgtggcatgggccacatccctgcttgcctgcatatcggagtgtaagcacttctgggcgagcgagccaggtcctgattgccaagaaactccctggtatctgacactgtgttctagatgagggtgacggggagctgtgtgtctgaggatatctgagaggcaagtgtgtgattgggagcttcagaagataacgggtttctctttgtctgttcacacaggctggctccagcactgctgatgggaatgtgctctctgtcctgcatggggtctggcggtcacaggggctggcagggtaagacgaggaatgccctccttcctttcttcctctccaccactcctcctcctttagcctaactttggatgaacacctctccttcccttctgcttatgttctgctttgagtttctatttattgtgcaaaatattatagttgatgttgtatatatgagataacatagcaaatcaaattgacggattattccagccaggcagttctcagccttgcccatcttgatgttagatgaaattcacatgtgtggctctcaccagggtctgggctgcagcagtgataaaatgggcttctcagaggttacacagtgcagaaatacaagggagtgaagggaacattgttagaagaaagcatttgtggttttgatgcttttaactattattagtaacaaattactttgaacataccatagtgcaggtgggatgactccactattagcatcaattgagaaccattgtgctacagaagtgcctcagacttctagcttcatgtcctaaaagctctctctgcaagattaaaacattgctttgacaccataaacttgtgaagccgcctgaatgttgagatcttacaggcatgtgaaatgatgatttttctcttagggaccatataccagggattttcttgcaagagcaaagcagtggcctccctttgcagagggtcggtcggcagctgcctggacttcgggcgtctcagctggcagtgccacctcctcatcctgatgccgagttggatcacttatgtgattgtagtttttgtgtacctttggcagttttaatctcagctatttgatgatctggaggacatgaagtaggtgagtcaggacccagttaaggtttttataggagagcagcacatcctagattgaaattttccagttggaagtttgaaaagtaggtgatattggatggttttgttgaatgtgacaactctgagggattgacgttgggggtgtgaagggtgtcacggttttgaaacaagaactggggcaaagccagaggaataattggctgttgacgtctagtgagagcgtgggaagggcctagtggggggcatgtgtgctgggagcctgccacttagggctgccatatcgtgaggggtgcttctatctgtggcacattaattctgctgccagttccacagcaaacaaaggaatggggtgagaaaaaatgagtcctgaagctacttagccagtagcaggtaaaaggtgcttaggggccgggtgcggggctcacacctgtaatcccagcactttgggaggctgaagcaggagggtcgctcgaagttaggagtttgagaccagcctgggcaatatggcaagactctgtctctaaaaaataaataaataaattagcctggtgtggtcgcacgcacctgtagtcgcagctactcaggaggctgagcaatcgcttgagcccgggaagtcgaggttatagtgagttacaactgtgccactgctctccagcctgggtgacagagcaagaccctgtctcaaaaaaacaacaacaaaaaagttcttctgtgtttcaaatagcaattgggctacatacatggagaagtcacattcagtggcttttttagactgtaaaaccaaactgccaaatttcactgtcctactgatttcagtgtagttcatgtttgattctgtggcaactgttgggcaaaccacttcaattgaccttagctttgtggagctgtgcagagctgcagcccctcagccttttctggagacagtggtggcaggtggggatggcatgatcgactggcaaccccatggccccaaaagctggtaggagttatgttgagtagatgattgaagatagtcttccctgtcctggttgtggcatgtcttatacttgacgttataatactaagcagtgccagaaatacaggcagaggaggggtgtcttcctcaggtcaagggcctgtccctgtccccattgtcagctctgtaaaggtcatgtggaattttttttgcttatctatcttcggaaagtctcagaagtcatgggctctagtcagtctgtacagtgtagtccctaagagcattacagacagcagcggtcgtcacttaagggagttttgattagccacttattaatgattaaagacaataaataatttgactaaaaaacagtcacagaaaaacctgggtggctgttgtgaacagaggtcccaggcaccctcagcctgaaggtatctctgccagcttcctctgtgctccaagcacacagcgctgctgccacctcctgtctcctccccggggcgtgcactaagtttactaggtactacttgggttttccagcagacaccatctcctcaccttaggatggaatggtgctgccctctcggggtcaagtcaagtggcgaccacttttatctttccgtgtggtccacgcaggtgaagaccttgttctggcgcatatgggagtacacatataaacagaaatatattactaaacaaacaccgcgtgttcattcagccccgtagccaaaggcagatggggagcctgcccaccccggatggcccctttctggttttcttcactcatcagctggctttctgtttttgttgactgtgccctttatgtagtagctgccactgccgcgagcatccctttctgtctggcattgtaagtgcttacgtttgctctcatttaatctgtgggcactagaacacgctcctgctcaactcaaaagtcttcacctgcgagactggctggggccctcactgtacaaattactccacgttaaggccgtaattacgttaatagattcagtggtcatctgttgaaaccataaactgcttccatctgtgtcttgccaggagcagctgagcttgtgagtggcagaagctgaacaagacactggcgtttagaaataagtaaggtagtaaaggtgggagaactttgtggccagagtggtctcccacagctcggcatctgctggccgcctgtctagcactctttccttcgtaaggtaggagcagggaggctcatctgtctttcaggcaggaaggacatagtggtaatttataagtttctgtcctcaccacccaccctttgcatgatgctgattttttttttttttttaagcaagtgtagtttggttttcaatacaattttcatggttatttttggacaagtaatcgtggtccttaattttatgtgcagtattgtaatgatttaaacccatagctagctaactaaaaagggcccacaaaactcttcttaagtgtctcattttccttagaagtgccaagtgctgcaaacagagggaggctgctcagcctcccccaacagctcaaaggtgttgggagaaaggatgcagtcaggtgctgggagcagcctgcagggaccgtcttcctgccatgtttctctccaggccaccagcttgcttgtcatggaggcttttcctgtatcttaaaggatgcatagctactgttggcatacttgaccattttcagttttcttccatagacctgaccagaagtcttttcactggcatatgcactagttttgccttcattaactctttctgcttacagaagtaatacaggcatattttgtttaattgcacttctcagtgcactttttttccaaattgaaggtttgtggcaaccctgcgttgagcgagtcttgcagagcccttttccaatagcacatgatgactttgtgtctgtgtcacattttggtaattctcacctgtcaaatattttcattatcatatctgctgtggtgatctgtgatcagccgtcttcgatgttactgtaattgttttggggcatcacccactgtgtccaccgaagacggcaaacttaatcgacaaatgtggtgtgggttcgggctgtgtctccaaccagccattccctctctctctcccttaggcctctattctgtgagacacaatattgcagttaggccaattaataatcctccagtggcctctaagtgttgaagtgaaaggaagaatcacacctttctcattttaaataaaaaactcgggccgggcatggtggctcacacctgtaatcccaggattttggggggccaaggtggcagatggcttgagcccaagagttcaagaccagcctaggcaacatgccaaaccctgtctacaaaaaatacaaaaattagctggccatgttggtgtgtgcctgtagtcccagctacttgggaagctgaggtgggagggtcacctgagctcagcaggtagaggttgctgtgggccacgatcgtgccactgcactccagcctgggtaacagcaagaccctatctcaaaaaaaaaaattaattaattaaaaataaaagctggagatgattaaatttagtgaggaaggcatgtggaaagctgagataggccagaatctaggcctcttgtgacagttaaccaaattgtaaatgcaaaggaaaagttcttgaaggaaatgaaaagtgctatccagtgaatacacaaatgataagtgtaacagcctcattgcacatacgaagaaagtttggtctggatagaagatcagaccggccacaacatccccttaagccaaaacctaatccagagcaaggcattaactctcttccctgaaggctgagagaggtgaggaagctgcagggtttgaagttaggagaggttgattcatgaagtttaaggaaagaagtcatctctgtaacacagaagtgtaaggtgaagtggcaagtgctgatggagaagctgcagcaagttacccagatctagctaagatcatcgatgaaggcactaacactaaacaacagattttcagggtagatgaaacagccttcgattagaagaagatgccatctaggactttcctagctagagaggagacatcaatgcctggcctcaaagcttcaaaggactggctgactctcttgttaggggctaatgcagctggtatctttaagttgaagccaatgctcattgactcttctgaaaatcctagagcctttaagaatggtgctaaatcgactctgcctctgctgtagaaatggaacaacaaagcctgagcgacagcacatctctttacagcatgctttcttgaatattttaagcccactgctgggacctagtgctcagaggaaaagattccttttaaaatatttccgctcattgacagtgtacctggtcaccctggagttctgctggagatgaatgttgttctcatgcctactatcaacatccattccttagcctgtggatcaaggagttactttaactttcaggttttattaaatttcataaggctacagctgcatcaacagtgattcctttgctagatgtgggcaaagtaaattggaagccttctagaaaggagtcaccattctagataccagtaagaacattagtggcttcataggaggtcaaaatattgaccatgctgggactttggaagaagttgattccaatcctcatggctgactagtggagggaaacacatactagatgtactggaaatggcaagaccaccgtagtcagaagtggagcctgaagatgtaaagaattgccacaatctcatgatcaaacttgaacggatgaggagttggttcttatgggtgagcaaagaaagtgatctattgagatgaatctactcctggtgaagatacggtgaacactgttgaaattacaataaacgatttagaatatttcatcaatttagttgagaaaacagtggcagagttgagacggttgactccaattttgaaagaggtcctactgtgggcaaaatgtattgtgtgctacagagaaatctttcatgaaaagaagagtccatcaatgcaacaattactatttttagaaatttccacagccactccaaccttcagcagccactaccctggtcagttagcagccatcattcaaagcaagaccctctatcagccagaagattacaatttactgcaggctcagatgctcatgagcattttttagcaataaagcattttaaaattaaggtatgtacaatttttagacataattgctactgcatacttaatagactgtagtagaaacataacttttctgtgccctgggaaacgaagaaatttgaatggcttgctttattgcaatattcactattatggtggccaaacttggcctgggaccaaacttgaaatatctctgagtcatgcctgtactcttggtgaaaaggttcaaaggttatggaagcgtgggccaggaatgtgtcctataatccacaggcagcaggcattcagtttagggcttaagacacatccctggcttgccttttagatatggaatcatagtccttggacttagttttttaaacctgttttgtaatttttttatgttggcatctgtagatttcctcatctttatcagctacataatcatccactgtatgtttatactgtgccataacttatatcaccatcagcaatgccacaatgaaaatttttgaacaaatatctgagtaggtatggggagggggggcagttttaaagaatgaatccccaatttgtatcctcgtggcattgtagttttactttgcattgctctgattattctacattgcaccttggctggttagcagcaccttctgtgataccaaggggactgtgcaggtggaggcatgctgcccccttcacagccacagcccatttgcctttcatgcctttagacagaaaaggaacacagggaatccatggaggttcaactcgttgtcgtgacgtcatgttttggggtctcgaaggacaaaatgcaactgagtcagtgggtggagcggcagcattgcccaaaaatctcttcactgagcaacccctggagatcactttagaggtgtgggctggaagtgccttccagccttacctaggattcagctctttaacacctttttaaaaaaaatcaatttcatgtttcaaagggaaaaatggcatgaaagttttagaactactgttgggacacagctattacttgccttatttgggagcgttcacaagctgtttggtagttagccactaatgagcatggtgtattgagctgagcaagctgtgggtattggaatttaacctttttttaaaatacgcacaacattaaaaatcctgttttttcccctagattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacttagggattttagaccttgactaacaagctccaggtgtagaaaaattcaaaacaaaatgtcaggaatctagcagtgttgtctgccctggagcaaacaaacagtatgtgattttgcttcgcctattttttttttcttttttgggggaagataattaaaggcagaatgactgcgtttgtaaaagaaggaccaccaactatactgacatttataaatgaacctttattaaagacacttcaatgccatttgttagacacttcaatattttacatggttttcaatgtacactgtaccaaaatttctataaataaataactttgtacataaaagtaatactccctctttcacattgcctctcagaagcagcaaattcacatattttgtggaagtaagattagtcagttaactgtcaagaacaaaattctaaatgtgcttaccttttgaacagtgatgacacctgacagtaattgttaactattttctcagtaactcccttcagcttttggccaaaggaacatttgaaggaccttgtttctatttaagttttactaaatgacacattggcactcataagatggttagctaccagtctcaaaagtgcaaattatacccagaacccaggtcaagggctgtcctttccagtcccagctcagtttcatctgtgcgaaggaatggcatggacaggcctgctctgggtccttagtagaaataaggtagccctgaaaagtcagaacttcctcctttctgtcccccaaggccaatgtaatactcattatattggcaaaacgaaaacatcagtatagaaaaatccacaggtaccaacaccagcagcctttaccttaatttaaaagtctcaaatagcaatcgaatgatactgagaaggccacatttgcttttatcataaaataagaggaggaggaaaggcagtgtttaactgttctgaccttttgcttgtgatggattaacaaccctcattctacgccttacagacggacagattctacgccttacagacagacaggacttaaacctaaaaggaaaagccattcactgcaagtgtggatggcacttgcacccctggctctacagacagggaagcctgttgcaggggcatccacacatgagcagtgctcacctgaagctccttccggcgcatgtggagtcccaccgcacagcagcctaggggtctatgaagtgcaatataaatccaaggccttccatccttcccaccccgcaccaaaaactcctgtgaacaaatgtggttgtagcctctataaattccagccatgcgttaaggcaccagaactatttccccaccccctccaaaattaaacagcaacctgatacgaaaaataatattgtcaaaattgtataatttttttctgttaaccatgcactaaagattaaaatagcctctgtaaaagatatatatgaaatctctgaaaactcttatgtacaatgatatcaaatactttttttgccttttgtacacaaatcccctcttgcgtttactgtgcttcagatccaagtcctgtgagcgactgatactccacatgggagttacaactatgtacagatgagtgacgcttgaacccaagcttcctcgcagcctctcctacctctctttcccgtagagattggtatgacaagaactgaggtagacaaaacctagctttttggtgccaacagcagtggcaccctctgtttcccggggagctgtcctgtcagtggcgtggactcgggactggcgtcacatgctttggggaggtggccattggaaacaagcaagtactgggcttccgcgcgctctggactgcctgaagttaatgaagatgcaggctgtagctctgtggagtccgggtgatacaaccttgctaaagtccaggaagaatcccctacaaggaaagaacgaacctgtcagacccccacttgaccgtttaagcagctcccaacccacctgttagaagacagtcaaaagttacctttcccatctagagatgccattggctttttcttcacagccgtcagcattctatcgtggttactggggtagagcgacccttggcactcggggcaggacccagcggcagtcctgctgcactggtgatgtggagaatgctcttggtcactcccacccggctccgggccatttggcgcacttggctgtgcgctgtctctggacacaggctgggggtggaaggcttgtcccctggagtaacagtccacttcggtgttgcagtcactgcatacgacccggccaccgtgttctgaaggacagcgccaaagatgggttagagtcactgctgtgggagtcttcgtccccacacagaggacaggctgctcagctccactgtgcaaggtgagaaccctgactgcaaacactgtatgcatgcttcctcttttccccaactatgtccccagagaaaggactgggcaaacaccaagtcactcatgaactgtggggtctttcgtgtttacagtgaatttcatagacaatgtagtcttactgcttcacgggggaaaagccattagccttaggtaccatgcagtgttgggtcttttcaacaattagaaataagcctcaaaatagccctggtgaaaaagtgctgactgaaactctatacttcgtttgtgccttgccccttatttaagttgcttatacatctagaaaattcatgctcaggcttaccatggcgtagatttatttaggagaaactatcctggaattaagagagccaggcctgagcttcccctgtatatactgaataccaaatttggagacagctgtggactaggaatgtgtctccccctttgatgtagtgactaggtcagcccaaatttccatttcagaaagaaactacttccaatgggaagcatctcatacccatcttatgtggcccaggtgtcccttcagctttctccatcgctttccacggctctttgtgatacgcagacccagcacagagctttggctgcctgcaggcaacgctgtgagtgtcgggctctggaaagtggcttgcatctcttggacacacacctgcaagtggattccaacacgattagaaactctgggcttggtatttcacagtaagccttatgaaaggaatgagcaaggccgctagaacagtcattttttttaaaaagttcttcagagcggtggggctgctggtctggcaagcagcgtgttttctgctactacttcccagcaggcaggctggccttgtgaaatgagcagctgtctcagggtgagcctctacagtctcaggcaagtgctcagaggcccccaccgttggaagtacctcatcctggtgacagctttccagtgtaagactggatcacagagcagacctgggcacgttccccatgtaaggaatgggttggctgggttcatgcaccgtaatgccctttccagctgctactccaggcaagcctactttatcctgccagggagatgctaagcccaatccagtggcttcctgaggggacaggactttaaaaccttgcagaactcatgaagactgggtccaaaatagcagcccttagtcataccgccttctacttcaccaagtttgccccatctaatgccaggtacctgccctgtaaagacctggaggccacctccagcacccagagacacagtcacagcagagctctgcttcacagttactgaggccttaccattgctctcaatgtgcccattggcctgagggccaccctcggtcctgaccacggtttcttgtcggtcagaaagggtcccctgagaagagaggtagcttggaacatctggtggcacgacggtttcatctgcaaggagacagaacaaatagaacaccagggtctcagtgacaagaaatgcagacacacgttcactgtcaagctcagaaaggggatcctcccagtgacgaccatcagcgctgtgcagagagatgacatggagtccatgtacgcaacaggccctcccagagcctgctcagctttactctacacccagcgtgaagagcgcagccagcagatgccagacgccacaagaagtggagaccagtgatggaaagccggggctcacagaagtaccgcactgtttcaggaacaacctactacgtggcagcagggcctgtgcataggcggcctctgagttagcaaggagagggaaaactgcatggtgcgtcagttacttgtatttgtgagtattcctgtttaaggttaaatttgagagtattcctgtttaaggttaagttcctcaaagttaaaatggaattagtgggactaaaccctcaggagttctgaacacagtgcaattctttcaaaagccactggaacccggcccagttccccagcatcactgccattcctccctccttgaaagtcagctccgctggcagggcctgacctgtgttggtgacactgtactcttcactcttcttcctggtctggtagatgatgcacacccagaccagtgacgtcaggacgatgctgctcacgacagcaatggtgaagatgcctaccgtggtcccatccttcctgcagcctgctgcgggcaggacgctcagctggctgtgagctcgctccgtgcccagggtgttggacatctcacaggtatatcggcccgcatcctctgccaccacgttctgaaccaccaggagctggttgtcaggggtcaagtggtgccgctcagtgaggctcagcgggcggtcccccttgaaccaggtgatgcggggcggagggttccccgtggctttgcattggagggccactgtttctcccacagataccacacggtcttccaaggggaccaccaaggatggggtctctacaagagagcaacagagatcttagtcattctcagggcctccgttgctctggctctgcccggtcttctggacaacggacaatccaacatatcaatgagatgcatctgagattctgtctcagagtggcaagctttggagaagacccttcaactcattgactgagtcatctccatgctgggagtggcttccacagggacagtgaacctctgctgacaaaagcccctgctattccctaactgtcctgtgtcaggcctgtgtccttattcttgaccaagcccacatccatcctgtccaattcttaaaatgttctgtagctcttgaccaagcccacatccatcctgtccaattcttaaaatgttctgtagctaaaccctatgaagactcttaattcaccagctatcatttcttttaaagagatagaaacacttgtttaagaaaaattaactcaactcaaaaagcagccccaaatttcaaacagggtcgaaaggcccacaacgcataccacccctggccacacagagcatttgagagtctctctctctcgctcacacacacacacacacacacacagtagagcaataggcaaacctaggacagtcagggtggcattagctgaaatagaaccggctgagttctgagcagtacagctgtaaacccctgcgtcatctattttcacatcagtgatgaaaaacacgtcgtcatccggcatgacatgcatgcgtcgctcacgggcagcggggaaatccgtgcctccatccttctgccaggcaatctgagggtttgggtgacctgtggcagcacattcgaggcgggccatggtggtggtccggatggttatgtcgtggggcgttttggtgaatgatggcaacactggaaaacatacgtatacagggtcgggttacgggacagctagatgcaaaaccaggaagtcctctggcaaacacctacctgtcactgtgcccagtgccagttcacttcttttctcccaatgtctgcccaggaccactcctgccacctgtgaatcaggaacccccagcttctcccaccacagttggaacacttccatcccatcagccttgcattgtacaccctaggctggctatagtcccttcaaagcaaaggcttttactctacatggcagtgcctatacgggagttgcagggggtgcccatccacactaggtaggcctgatgcttgcctgctttacccaccaagagagaggctgtggagatggaattacagagggaaggtgggcatgcctccaccttgggagagcaatgggatggctcatccgtttggatgggtgttcatgggatgaatgggatggctcatccatttggatggttgttcacccaggctgttcctgcccactgccgtatacccaggcaggaagcattcagcttgctagcttgctcagcctaaagatcgatgtcctgacagagtgggacgcatccagccacgtgtcaggcaccaccagagttcctgtcaacgtcaattttggggagagtctaacaaacagctgagtctttcggaagctgtgaggacttggaataagccaagacaaccccactacagtgtggtaaagaaggtgtttcgctgtgatctgtgggggcttaaagagcaaagcagatccaccattctgatgattctcaagccaattctttttaactagagagttagtaatcaggataaccccattaggttactggggtgggacagtaaactcttcaagctatctactccccacccccctcctccaaacacacaataacacatggtccccttgacaagctccaaggctggttaatgagtaaaaacctgtcaactgccaggacactgtgtctttcaggccagggctcacaccagccttgcactccacagtctctggagcagtagctagcctctgactccaatgctgtgccatctactcaaagaacagcagcttccccaggctaaggggtatttggaatttggaagccagatctcttggcttatagaggataagaactggacaaaacaaggcttagctctccacaatttgacttaataactagtttttgttttgtttttgagacagtctcactttgacacccaggctggaatgcagtggagtgatctcggctcactgcaacgtccacctcctgggttcaagcaattcttgtgcctcagcctcccaagtagctgggattacaggcatgtgccaccacacctggctaatttttgtatttttagtagagacggggtttcactatgttggccacactagtctcgaactcctggcttcaagtgatctgcccacctcagtctcccaactgctgggattacaggcatgagccacagcacccggccaataactagatttttaaaactcaccaaaaacaagtaactcattgtgaataacccttgaaatctgcaaaacttgctctggggcaaacccaggcaacaataggatttaacagtgccccacagaagcatgtgtgtgtcctgtctcagtcatctctacatggaaagctgaaagggcaatcaggagtgtgctttgtaggattctggtactataacaaagatggtgtttccataccattcacggtgagcctggccttatgtgaataggtggagccaaagtggttggtgatgacacattggtagcggccctcgtgcccgaaagtgacctgacggaggtgcaggatggtggtgtactccatcacttccccgtcctgcgcgtggacgtggacaaagttctccatgtctgcattggtcaggacttcattgtctttcttccaggcaaaggtcatgggggagctgctgctgctggctgctgagcatgtaaaccggatgtccttgcccaccatagccatggtggtttctggctgggtgatgatctgtggcttcaggaagtcatctggggagagaagggtcaactgtaaagcgctgggttcttggtacacagaggaaccagctgctgttcatgctaacagaaactgacacagacaccaagcaggaaccagagcttgaggtccctgtgcatcctcagccccaccaaccagatgccgtaagagttgcaccatggacatctgacctcatctaattagaagtctgtgagtactgatcacctttatgatcacactccttgattagaaattaacccaccacttctcagttctcaaaccagccagccggcagtttccttaagacaactggctctgcctgctgactttcacacaaaacagtcaggcaccactggtcatgactgcagagatcttacccacaaaccttactccaaaaggagggggtgtaaaacacttccaaaatgtcagaataaggacctccaaaaatctgcacctccattaaaacaaggaaaacacctggaaaaatggtcaaaagcaactttttcagaattctggaaaaccaaaggcttacaacaatccatggattgttgattcaagcaaatagcaacatctcagaaatgtgagctttgtggtattttaacttatccaaagccccattcttccctccccagctccatggtagccttgaaacccagcagcctagcaaccactcaagggtcagaatgggctccccaaaagccccatcctcagaactgacaccatgtggcctatctggcagcaacacggaaagccccattcacaggatttgcattgatttgccctgatctagtttgccgagcaggagaagccctagccccagggcacatgactacaacaatcagtagccactgttcaacagcgcagctgtctgaggggacaatacccatggggcaaacaagcagctggccaaaaaactataaaggaaaatgtggggaatacagtgttaatggtgggctttgaaaaggtccaatacattcctggggatctagacagccacatgcaggtgcaaggccatgtgcacacccaggaaagacgtgagggggtcctcatttgtcacctgtggctgagcatgactgtctacacaaataggaagtgatggcacaccccaacacaaacacacaagccgtcggtaaaggataggagacagtggttgtggtgacttctctgtccaaccattagctaaccactaaactaaacaagcagggacttaaggggacggactttatatagcctttgtccaggaaaagtcactaggcaagctgtaacaataaacagcaacagcagcaaatcctgggggaggagaaagggaatatccaatttccagagttgccacattattttattttaaatgcccaattttcaacaaaatattatgaaacactcaaacaggaaaaaaagcagtcaacagaaactgtctctgagggagcccagacttagattcactaaataaactttttaaatcggcaattataggcatattcaaacacctcaaggaaaccatgtcttaaaaaaaatatcgaaggatagtggccaggtggggtggctcacgcctataatcccagcactttgggaggctgaggcaggaggatcatgaggtcaggagatcaagaccatcctggctaacatggggaaaccctgtctctactaaaaatacaaaaaaaaaaaaaaaattagccgggtgtggtggcaggtgcctgtagtcccagctactagggaggccgaggcaggagaatggcatgaacccaggaggcggagcttgcagtgagccaagatcacgccactgccctccagcctgggtgacagagcaagactctgtctcaaaaaaaaaaaaaaaaaaaaaaaaaaggataaagtatgagaaaattttatagcaataaagagaaattatagatatgaaccaagtagaaattttgaaacttagaagtacaataactgaaatgaaaaattcactagaggggcttgacagcagaactgagctggcagaaggagggggcagggaacttgagacagtcaactgagattatgtagtctgagaaacaaagaaaaaagaatgaggtaaaatgaaaagaaccacagagacttgtgggacagcatcaagcacaacaacatacaaatcatgggagtccaagaaggagaagaaagaaaaaggaagagaaaaagtatctgcaaaacaatggccccaaatttgatgaaaaatgtgcagccacacatccaagaatcttaatgaactccaagtagagtaaattcaaagatccaaacgcagattcatcatagtcaagctgtcaggtgccaaagacaaagaatcttgaaaacgcaaaagaggagcaactcatcacattcaagggatcttcattattattaacggctgatttcttaccagaacccacagagaacagaaggcagtaggaagatattcaaattactgaaagaaaaacgttcaactatgaattctatgtattaaaaaacctatccttcaaaaatgaaggggaaattaaaacattccgatgtttttattttaaacacacacagagcaagttgactgttatcaggcctgccccacaagaaatccaggagagtatttagtatggctgaaatgaaaggacatcatatagcaactccaatccacaccaagaaataaaaaatcccattaaaggtaactacacaggtaatacaacacacaggatacgtgtatttttgtaactcgcgtctcctgatttaaaagacaactacataaaccagtaattataaggctgtgttgatgggcttaatgaaaatgtaatgtgtacgacaacagtaacacaaaggaataaaactggatcttaataggaacataatttttgcatattactgaagttaatttcattatttatttgaactagattgttgtaagatgttaattttaattcctatgggcaaaactaagaaaataactaaaaaatacccgtgtatttaaaaaacagggaattaaaatagtacaacagaaaatatcttttcaataaaaaaactagtcagtattggaaaaacaatgaaacaaaaagataggacacatagaagaaataaggggcaaactctaccttattagtaaatgcattaaaggaaaatgaattaaacactccaatcaaaaggcaaagattaccataatggataaaaaaaactatgatccagctatagcctacaagagacacagtgtggattcaaagatacaaataagcagtcaccaaaagagaactaaagtgtccatactactaacagacaaaataggctttaagacaggagtttttactacagagacagaataatattttataatgtaaaagggtcaatgcatcagaaacacgtaaaaatgataaatacatatatacctaatggagcgccacaaaacataaaatctgaccagattaaaggaagaaatagtgcaacaataatagtttgtacacttcaataccccactttcaacaacggatagaactagtcagaagatcaaggaaacagaagacttcaacaacactatgaggggacttcaaaaagttcatggaaaaccgaattataaactttatttctcaacataacctccatcaagtttgaaactctcctgagtgatgataccagccatttagtccatccctaaagaactgagggtcctgggacatatcaatgcagtcttttttacattattaattgaagaaaattgggtgccctttaaagatttttaaagataataactaaaaagaagtcagatggagccaaattaggacttttaggtggatgtctcatgatttcccaccaaaactctcacaaattcactcttctttgtattagagcttctagccagtgcaacaggctagagaaagaaatgaaagccacccagactggaaatgaagaagtgaaactacctttttgcaaatgacatgatgatcacatataaagaaaatcctaagaaatttactgaaaaacttagaataaatgatgtcaacatatatgcaggatacaagatcaagatacaaaattcaattacatttctgtatacttgcaataaatatttcatttttgaaaatccaaaagtgaaattaaggatttcatttacaatagcaaaaagaataaaaacagaaatacctttaacagtagttgaagatgtgtacactgaaagtgacaaaacatgactgaaagaaatttttaagaagctaagaaaaaagggtggacagcccatcttcatggattgggaagacttaatactgttaagatggcaatacttctcacattagtctatagattcaatgcaacccacatcccactttcctttactgcagaaattgacaagctgatccaaaaaattgtaaggaaatggcaagggatccataatagacaaaacaattttgaaaaagaataaaatcaaagggctttgtaacactaaggttataaaactcttagaagaaaataaaggaggaaatctttgtgaccttatctcaggcaaatagtttctttgatatgacatcaaaagcatacgtaataaaagaaaaaatagagatattgaacttcaccaaaattaaaaacttttgcatttcaactatcaagaaaatgaaaaatagccctccctcagactgggagaaaatattggcacaacatgtatcttatgaaggtctcatatccagaatacataaagaactttacaactaaacattgaaaagacaaatgaatactggcaaatgatttaaatagctgtttttccaaagaagatatatatatatatgtatgtccaataagcaggtgaaaacatgcctaacatcattaatcattagggaagtgcaaatcaaaaccaccatgagactctattttacactcacgagtacatccaaaataaaaaagacagttaataacacatgctagcaaaaatggggagaaattggaattctcatgcattggtgatgggcatgtaaaatcatgaagccactctggaaaacagtttggcagtccctcaaaaaagctgagcacagagttagcgtatgacccagcaattccattcctaggtttgtacccaagagaatcacacaaaaccctgtatatgaattttcacagcagcattattcataatagccaaaaagtggggacaatctaatgtccatcatctgataaacggataaataaaatgtaaacccatttattcagccatgaaaaacaggaatgaagtactgatacatgcttaaaaattatgctaagtgagaaaagccagttacaagagaccgtatactgtatggttccatttatattaaatgcccagaataggcaaatgatggagacacaatgagattagtgctatcaagggcctgggggcagagaatagggagtgattactaatggtatggggatccttctagtggtgataaaaatgttctaaaattagataatagtgatggttacacagttgtgactattataacaaccatcaatttatatattttaaaggggtaaatttttatgatatataaattatatttctttttaaaagcagctttattgagaatacttcatctacactacaactcactcatctaaagtatacaattcaatggtttttagtatactcaccaatatgggcaaccatcactacagtcaattttacaacattttcatcacttcaaaaagaaatgctgtacattttagctattacccctctctttccatccctccccatccttaaactactactaacctaatctctacctccacagatttccccattctggacatttctatgaatggaatcatataatctaatggtcttttgtggctgacttcttccacttagcatgacattgtcaaagttcattcatgttgcaggactactgattgctttcacagcctaatgaatattccattgtatggctataccaccttttgtttatccagtcatccactgatacctgggttgtgcccatattttggccattatgaataatgctgctatgaacattcatgaagaagtttctgtgtgaacatatacattcatttctcttaggtatacacccaagagtggaactgccaggtcatgtcgtaactggatgttgaactgaggaactgccgagactgttttccaaagtggctgccccagtttacactcccaccagcagtgtaggagggttctccctatcctcagcaacacttgttattatctgagttttggattctagctgtcctagtggatgtggagtgcttatgtttccgtttttaaaaaaggagtgggagactcccataaagcctgaaaccttgatcttctgccaagtgttttcatgattcccattaacacctgacgtttttagagggggggaagcttgagctaaaatgtgggggtggggatgacagatgtgaaataaacaactcttgcaatccagaatatgccagggccacaggctgggggctaggtgaacttaccaaagtcctacctggctcacccagagggaaagcctgccctatggcaggaaaggggagggagcgatggaaagctttatttgagggaggtctataaacaatttaagggtcaaggacttgatgacaatgggccaatgaacaatggattatacagccattttgtgcctggataatggagctgtgcgagcattagattccacacagaaggctccataagacagatcggtatgaaaagtcagtttggagagctgctgccatgttcgcagtgggtttaagacgtgtccctggtctggatccagaggaagttcagcaggcctgttctcaaaagtggtgatggtgaaggtaggggtggatgcatggagagggcacacacatcttgcctccagcaggcacactggctactccagcaggcacaatggctattgctatggccagaaagtaggagacagaagtggcccacaagggttgccatatggatgggtgagttcctggttaggatcctcacagcagggatctcaaggctcaagggagaccagtgagcacaaaaggcaggagggacttaacacctgcccagcagttccagtcaggcctgggaatcccactcttgctcctgcttagagcaagcaaacaggaaaaactcaaaattcatctcattttttgaccatgtcttcctgaccgtgagcctgtgtcagtcctgtctgagctagcctgcgtgtgtgttttcagctgttcagcattttctgtgctctctgcaaccaaacttggatcccgactcccagtcaaaaagatggcaagagctacgctccaggaatcagaaggcaaaaagaatgtaaagctgcaagtgcagatttcagtggtttggagaaacagcaagagtacaagtcaacatcaaggaattatttttactacagcaactgttctcctgagacttgttcttcctgtatttaacctttcattcttggggtcggaaagaaacacacattaaaacgccagcctcgtacgcggagtacattcgcagctaaacccgggcaccagagcccttctgaaacaacagaactatcttcctgtaactgattattctgatttgtaactgaaccaacttatactcccttctgattaaatgcatgtcctccaagaaccacataatgaggcaactctacggtaaatactgtgtgtggtttcagcaagaaataaattgcatccagcagctgatctgtaaccacgggctggggtttactctgatcacaggaattactcccataatgaagagtacctcctggcttccttgtccttcatgaaggagagaaaaagttacaaagacagtcttaccgcacacgaaactctctggtggcacagagaaaatgctctgacccttcagtgattctgggtgggcacaggtggctgtcacaaaggcctgcagcatcctgccaattagccacgggggcagccacttcagctggcagtcacacaggaagctgtcgctgctgatatggctgaaagaaacacaacagtggatgcttcaggtgcagccgcaaaggagggacactcccttcacacacacaatgatcagtcgcctccaatcagcttctcaagtgaacatcagcaagctggaagggggaaatggtttttctcacacttcctctccaatttcccagggcagtgcatataacccacctggagattttgaaaaaatgcagttgctgattgggtgggtcaggagtggaacccacgactctgctaacaagttcacgtatcatgctggggctgctgacccaaggaccgcaactggagcagcagcaacgtggagcttatccatgccatgttctgggacagacactgttcctgtgtgaccctgggctgccttctgacctctcctgacctctgatacatccaacagtgctatgctgccaccatcccccctctggtttttcccactttcctgataaactacttggagcttccaaactcggcctgagactttgatccaaattctgcaacaagttccgaggagggctcttttgcctcatggctgttccttttccatttggcaaagctgcatgttttcttacttccaaatgtaataagccccgtcactgtgccaccctcttgtttgtgccttgatctttgcaccagtattcttcagggggccggcagaattcggctctgctccctaaatagtgcttgttagttaattgccactgcccagggagcatgagaatgcacaactttagctttgtggggctccaaccaaaacagagaatattttctttttcatttctcagcaactaaggataagctttttaaacagaaatcggaatcgccatctcagcggacattccttcctgaggagtcacttgaagataagtcaaccaagagtctagctgccttgttcctggaagacctcagagctgtgagctaaagaatgatggctggcccacgataagggaagactgggaaagagagcacacaggcttccctgcaatacactgtctctggtacatggtgacaaacaggaggcacaggtatgcgcagaaattccaaaaacatcatgcaggccaagagcacgactttggctgccttctccacccaccactgtcctcagacatcaacaaagcaaccaaatggactggccttccattttcttctgtttctctccagatttctaatgagcagagaaactgtcacagcaaggaagaatgaagtgtaagcagatgacccaaggctaaattaagtaaaatccactcttcctcatgttccccatcacccctagatgagttgggcatcttattaaaataattataattttggaaagtgcttttccaaaaacagaaataacttatctcaaggccattataactgggatgctggcccatattagatcttaaaatcagcatgagagtttgcatttttatttcacgggcaggtagcgttctgctgagagccatctggagggctgtcctactgtggagtcactgcaggtggcggaagggctgtaacggccatccctgaggaaatggtcaattcccatgcagtgtttggggagggcagctcccaggagtgcaccctgcatgggggtcagggctggctgcgccaggcatggggggaactcagcctggatggagaactctccgctgtcagaagcacctccagctccccagcaagagggcacttccgtgcagtcaggcagaacagcctgggcactgttcacgaaagcctaggagagaaggctgggccatccctgtgcgacgttaagcatttgtgcaggacacaaggacatattccatttgaaccacaggaacaaacgggaaaacaaatttgacatttatctttgatcagacacatgtagaaagggctaagcctcatcctacacacgccctggacgtgtggggctaacgcctttgaggatttcctacttcttccaccatgaaacccacctcagacaggaggccagactccaggaagacagtgggtactcagggtggagacagcatgttcctaaacagcaagttaggactgagaggatacatggggagggcctggggccaggcagtagcgaggattccaacccctaggctctgcaggctcctgccgcccttcttccacccgtggagagcacagcgccatcggctctactgccttctgctgccatcccagggctttgctggctcacatggtgcattttcacgattccaactcaaagtgtgtttctaatcatcacttgtggaaatttacccagaggatgactaagtgcacagtacaacctgacttgatctgatggagaaaaagacgaccaagtggaattaaccatttctctcatctgaggactgggcacagggccggctccagcgaggtatatgcagcaacgatgggaaacccaggcaggagaccgaggctgagcctccagaaccatgcagaagcacgctggaggtccaagcttctggaagggtccagttcctcccaacttcccaaggaaaatcttatcctcctccctccttctctcaaaataccttcttcccgtttaaattgaatcaggtatttttcagtcctgacatcatatctgaaagtttcaaagacagaaaaggtgaaagaattccacagtgaatgctcctgtgccccaccgcttgtcttctacaaccaatgtttcattccacttgctttactgcgagtccacctctgagtccagccttcccttccacggtggtctggaatcatctcctcccctgctctggaaggagagccatggaatcctttctgtatgttccgtctcacccgacagatggaggcagagctgctgaggctggaagagggaaggccctgggcacggagcagctgtctgcagagccctgagctccatgaacccgtcacagacacccgctccaagatccaacccttgcaaggacggtatctattcagcaggcctgaggctcacagcatgctgaacatcacagggcaagtgcccaggccaccttccctcctcactcagtctggtgtcacccggcccgcttcagttcccagctatggggaatgcacctcatttccccagtcccagcctccctgccccaactgagggttcatcaagagtggcctcggggaatggggatgaggtcagggcacaaagatgactgtcctgtggcatctgccattctgtcagcacttctaggaaccaaaagttaccccttcagggaactgatatcatggctagaacttactggctgtagaatcagattcatgtctagctaaaaaaaaaaaaaaaaaaccagaaaggaaaacttgggtgttacacctgaggacccagactagctcccctgccagagtaggatacagggaagcttttccaaccttgtcacccaagagcccacagtccaagtccacagtggcagcaccaccacctgtgaaccgtgcccagaaagcttggaaatggtatgggcagacaccactgcacccctaagcatcccatcccctccagagctctgccttgctcacagcccaccaggctctgaagtagaccctctcaacacaggcctttatcgtaagcaagcccaaaagatgaaaacttggccctgacataattgaaggggtgattatccactttatagaggagagtatatttcacattgcctagaatagtggttagcaagcttcagcctgcggcccgactgcctgcttctgtcaatgtgactttatgggcacatagccacacccacctgcttatgtaatgtctatggctgctttctgctgcaatgatgcaatcaagtagtcatgacagagactctgtggcccacaaaatccaaaatatgtaccatgtgaacttttaacaagtgagcataatgcaattgcagaagtttcttactctgaaagtctccactaccattaatcagacccagggaatccagatacttacagctctttaagattcttcatcttcacaaaggcatcaaactggacagatctgatcgcattccctccaaggttcctgaaacagaacatacattacttatgcaaagaaaccctaggtacacctgaggggttttcaggacagtcctggtttcacagatgacccacagggactagccagacctgtgtcctaactactataagtggctgttgtttcccaaatcgcaacacaagcccatggaatgactcaggagccaagccagccttagggcaccatcaaagctgggctgaggcctgctcagcaaggcaaaacctttcccaacagagttagagtcaaacttgattcaaagaggaaacaaactaagaatcacatacatgaggcatcctccccagatggcaacagcatgactgtctcgggtggctctgttcccttcctcccagggtctcagaagcaaccacaccaaactggttcagcccagcacctactctgcattgttaagctgctttaatggaggcaacaggcttggccaggaggaagcgcgttggtggaagaggcaatgaggccaggggtccatgaaggagccagtgcaggggttaggctgcgcagcaggaggggggagggtatttatccaaataccaactgaattaactgggagcacatccactggccatatgttctgtaactgttcctggcataggcaacataaaggccaaagctgaagctgacataatgagaaggaagcagctggtgtttccaaatagcctgtttctcagtttacaaagatgcgattaaattgctagcagaactccccggcagccgcattcagcaggctgtgcctcagggcagggctggtgagatactcacaggtgctccaggccttccagccccgagaatgctctcttagccacagacttgatcttgtttccaaacagagtcctgtagtttccaaacatccagaaattaaggccagggaaggaaagcgaaacaggaagggttgagagaaagaaaaagaaaaagaaaacacacaattaaggtagtgctacctgataagtctgtccagtgaggggcaggtggaaagctgacctgcgctgagattacgggtttgaggcacgcaggccttcccctttctgaaatgaaatacttttatctttattagaatttaatagtgatgataggctggaattgcatgtgccgtctggcctaaaaaaggcccctcccagtgttaggcagaaatcaccttgtctggcccagtctctctccaaggaccaccaacccttgggtggtgaagtttagtgatggagagatgagactgattatggtttcagtgagaggaagctgagtcaaaaaaggaaagaaaaatcttcggaattaaaactgctgaccatgactgggcatggtggctcacacctgtaatcccagcactttgggaggctgaggcaggaggatcacttgagcccaagagtttgagacctggacaacatagggcaaccttgtctctacaaaaactaaaaaattatccgggcatggagacacgcaccagtagtcgtagctacttagaaggctgaggtgggaggattgcttgagcccaggaggtggaggctgcagtgagccatgattgcgccactgcactccagcctgggcaacatagcgggatgttgtctcaaacaaaaaacaaacaaaaacccccaaactgccacccacttctgaaaagtgcattctgggaataaagcttcccaaaagaggcaagaagaggacagtaaaataggcatccatcaagctggctccacagctgtctgcacctgagatgtcctggcagccagcacacagccatggtgagctgtgtccctgcctacgagagggacccctcagggcctgcaggagatgccccagtgctttggctcttaagccagaccccagacgttacatgatgtcagtgggccaacctccaacgttatcgctagtgcctgtccccttcctggactgcctgctcataaaaaggggttcctgcctccaggcaactctgatcccagccttagcagtaactgttaagagttctcccagaaaccaaagtctgcgcccctgcagaacacatggaagaaatgagtgcctcctccaccacactgtgtgatctaaagggaagcttgtctctctgcagggaagcccctagggtggacactgggaatgaagagaatcgagttttcccctccccgttatcatgttctctgatgagaacccaccaaaggcattccctctaatcctgatggcacaggagactaccagggaacaaccaaaggcagtgctgaccatcagcttcgtggacttgtcaatcttaaggtacaccaggatctaacaggctggctaagaataccgattgctgggagccaactcctggtgattctcagcgtcaacaggtctgtccaaggcaatggggtgcaggtgggcaggagaggaagcccctggagaaagcccatctggcccagccccctactgggaaggggactcttggtccaggatctcacctagcatcggggaagagaccggactagaagccatctccaccttcagcctgcattaagactgggacccataagggaaaacaagaagccccagccccttcctgaaaggaggaaaagaaaggaaatataagccctgaagcaaaccaaagatggcagggcagcctgggacctgcccaccacacgggccgctgcttcttcctgactgcaacaggcctcctgggaaccgcttgggcaggtaccaggaggctgcctcctggaaacacaggctcacagcagagccagagggaggcaccaccagtccgtgtggccagcttccagggcagccactccacaggggctgcctgaccctccgtttcatcagaaacagactccctccctgggggccaccattcaggatgaccccagcactaactgcaagctcagccctcagacaaagccagctctgtttcctgcctccggacggtgaaggggcaaacgggccagagaccctctgcgttttctttctttcaggccgtctgcatgaatgtgaaaacaatcgcattctgaaagcgtttccacacctctcttcagtctgaaacttttattttaaaacaaataaaccaaacacacagaaaagctgatggccatgctaacttaggcgctttaaccacaaaactcgccagcaagtaacagctcatggggcactgcaccccgagcgcttcagagagcactgccaacttctactcttactcagatccccccgcccaggcactgtgtgccccaggtcccagtaaaaacgcattgaactgtttagtgaaatctcctgtaaatgagatccaggaaaaagctgcgctttatttcatccattaaatattagtcacattgacctgttttacaatgagggcaggctgttatttttaacggtgacaatagcaataaaataaattctcaaattctcaattatgcaggggctaatcatcttgttggtagattaggcagggtccttaccttcccccagcagacatatggggctgggacggggagctgcagccagcagactgggatggctctaataaaaggctgctgccaggagaaaggagaggcgggattatgggctgggaggacactatttctgtaccacagccgggctccctttcagaaggaacacctggcctgacctccccagcaccaacctggaacagaaagcgacctgcgggagtcacctgtcaaacctcccatccatctcctggccaacccagccaacagctccaaaggcctggttagcgcttgccaaatcaagtggcaggtactgggggcaatgctcacatgggtccttgtactcatgtccttggaagtagccgcgacatgtgcactagcccccgcttcccacccacacacacaatgagttccactgcaggcccggcccccacataggcagggatggaggctgcgctcacatcagctctgcaagatcccccaaacatgccccttcccatgtgccctgtgtgggactctgcccctccctccgaggaatgccatggagccagctggaaccactgggcaggaagtcgcatacccaggtcactaactgctcctctctgcctgtaatttgggatccagaaattctcccttccctcccgcgtactgactctgtgccatcgtgcaggccccagcccgggaaccgcacaaccatttggaaacaggccctggagtgggtctacagcagaatcccagaccagttaggaagaaaggcatgcgctggggtctaggaacattcccaccctgctgggaagctccagtgtgaggaactctccaacacagctgtgtgcgtaagctggaaaaattaagggcaggtcagcatccaccccaaattcacagagaggccgtttatggctctgctactcacatctccctttcttggaaaacattttaatttaggtctgacctcttgcatggtgggaaggacccaaggtccttgagtaactcagcgaaggcaggggtctctaccttcccatcctagggcagaccctgaacacaagctccttgagctctccaaaaacaaacccacaccaaatgaagggactcaggcactggctgcactccccacaggacggatcagctgctctagaggggcggctcttctctgtgctaacacgcaccccacttctcagtggatcctaacaggccggcactgggccactcccacagagcaacacagtgctgtctgtggtcacttctctcagccagggccacagcgcagaactttcctggaatgttctgagtaggcgggtggggaggggaccaaagaggcactgggttcttcctctgtccctcccttcattcaacaaacatcgactcaacacctgtgataggccaaacacagcagtttttacatagccctgtgtaccatgatcatatgagaagcatttacttctccggttccctttcaatgtggaaatttgcacataccatgctaggtagacggagtagtatcctgaaccccaagtgcccgtgacacagtgccaatcctcctccggtcgtgccaatctcacctcatctctacctctagccactgcccgttctcaaacccagcaggagtttatggaatccaaatcataggcatcataccattttctttatccaagaagaaaatgattcatttttttcttttgccacataaccatgatagcatcacacttaaataagtgattgcatatatttaatcatattaaggaattcttgtttatttattgtcccagcttccccacttggatgcatgtctttctctctcaccctttttcaaacatacacagagtctccagccccaagatgctgactcagtggctgggtggggtgaggcttcgattttaacaagttcccaggagtctcaggaccagctcactacaaacaacattatgtgagtgaggaaagcaggggcttgggctgacctcttggggctcaggtggaagagctgagcctagtccagcagggggacaaaggagaaagcaccagggcacagagggcgggcactcaggaaggcagtggcggactcatgcagcactggaagcccaggcgacccagggccaggcacacctcacgggccttctgtattgagacagagcctcctggaagccatgacacccaggaaacggctccaggttcctccggactgacacgccccacgaggaacctggcagtgctgcccactctcaccaccctcacccttcaatcggttatggccgaggtcagggaggcttatgctgagtggtggcgccagtgctgaacacctcagcagccacatcccaggcctggagctcttcttgctaagaaggcctctgccccaccccacttggtacttctggctcttcccaggtttgccccgtatgggataaaaaggggtcacgtatgggttaaaggctggggaaaatcagcattgttttagggacaataaggagaagaatcactgataagcatctccgacatgctgctggagtacaggacgctcaagaagtaccttcttcagacagccaacagagcttattcctaagcaggacccttgtatataaaaggtgcaaaaagccacgcttttcaaaacaaatcagaagcatctactatataaaaagactctccctaccacaggctctcctctatcatcgagctccactagggctttccaaatatttacttgacactcgcactctgctgagctccccgtcactggggacgggctgggggaatcgagcggcagccgtcctctctgtcttgccctcctccagtcttccctccgagctgctagtaaacagtaataatgactctcgtccccttcctgcacggtccttgggtggcatctgcagaaagtgctggttacacgcagagaaaacagggcgggccaaggggaagggaacgtgggctttggagccaaacaagcaaatcctgagcctgccacttgccagccgtgtagttttgggcgaaatcccctcacttctctttcctcaactaataaagaggttgcctaacagagcctgccctcatgagatcattaggtacaacacacacaggtgcttggcagattaactggcaaaatctaggagctagctaggaaaaaaaagaaaaagaccccaaaccatacattcaaaatagctgctactacgacccttggaaatgacgtggttatttgagatgatggttaatgacgaaagtactgacaggagccccaccgccctcacaccttactgacctttacacaactttgagaaacccagtaacagggcaagactcctttgtacaaagggcaacagcaaattcagcagttttcatgtgagttgtgagtgaagcccaagagaagctccaccagccgccaaacgccgggttgccagcccccaagaacccaacacccaggccatcaaggagtggggtgtcccccaccctcttcttcaaactcttctccacaaacaaaacaagctctgccccaaacaaaagccagctcctcttccgcctgggcccagagcagagaggcgcggggggcgccacagaaacatctcccacccaagtgtgtcccgcgcatttgccggcggagctccgtgcggcggatactcacagcttgctgaggctgtcgagccctgagaaggcgccgctcgtgtcctctattgtgcccgaaatctcgttatggtccagatccctggggagaggacagaaagcagctcaccgagcagtcggggcgtgaagggaaagcaaactctcacccagcctgctgctcggaagctgaagtcccctgggtgcatgcaccctggaggcacagccgggacgtagggtgaagagacacgtggccctgggagggaagccctgtttctcagccttccaaccaagatgacacatgccttagacaagaaacttccctgggctccacctgcctccctgtctgcggaggccacactcaagggaagggaggtggtgcagacagcccagtctgtattctgccccgagagagcggacatctggccccagcactgagaatcaacccaaaaggttccttaaggctcccgtctgctctcataccaaccagagtcccttttctggacatgaccgagaaactgcagaaagcacatggaagaaagagacccggcacagggccggcccgtgggcgcctccgtaccagccagtgggtctggagcccggagcccatctcctcccaaggcctgcagggcgctgactctgagccagggaggacatctgggtgctgagtcagacttgtgacccactcgccaggatcagagggatgaggccaactcagcccaggcccctccaacaatgcaaatcccatggccgatgactcaatggcttcccagcttccaggagcaggtcacagtgcccaggcgagacatcacacctggagaccaggcccccatcctgccctctccaactttccacaaggttcttggttcttaaattttccccccgagcccttgcagacacaggccagggagagaaaaggaactcttgtctcctgtgagaagctgcagcaggaatcaatgctgccagcagagagggcagctctgactgaagagtgaaatgctggcggtgacctttcttgtcacagcaggaaggtcaaatagtggagattctgctgctggaagggacttctcctctcaatgggttccttcctatcatctgcatactgaaaaaaccaggaaccagggacccggggctgtggctttgtgtgcctgtctctctgctcctagccctggctgccaaagtttttctctcctttctggcccgctcagtctgaatgttcccagccttgttatttgggccttgtatgggctcacaggctgacctggcctgaatagcttggctccggcctctttcacactccctggcaatggctccacattaaagccggctctgccaggtgcaagtgcaaaggcctccctccctgtcacactggaacagatccctctctgtgcagtggattacgcctgagaaggagaccctagaacccgccaccactgtcctctgaaacctgcatgcccctctctgggggttttatgctgacagctgcttggaagttctatgaagccaaccatggaaaagttttatacaagcctcagaaaagcatcctgcagccacttttgccaaccccatctaattagggacttcaagggaaatggcattagcacctccactttgttaactgacccccgacgaggtacaaggagagacacaggattccctaagtgctgcttttggaaaggaggcatcttggtacaggttatgctgaagaagttcaaatgctcagacgagagatgcactgcagtattcccatggtttagagaaaaaatattcaggacttggaagttgcagctgaagactcaagatgggaaagactgacccacggctgccgaactggaggctgcaccaggcgctcagcgtggggaagctttttccaacactaggagccagcatcctgtccagcacaacgtgggcatcactgcttgagaacaactactttttaggagctgccatccctctctaggcaccatcctggggaaatgagagatttttctgcttaaccagttctttttcagttgattacataaaagtttgagactctgcacatagagcaagccagctttggatccaattctgactcgaagccaacgcaaatggagttcaacaaagcagatggtttgctctattctgctctccccactggggacccctttatcctgtcagtagtgggagacgtacaagactcgcaggctcctgagtcccttgaaggcaccctccgcaatgtggctgatggaattgtggctgagacgcaggacactcaggctgctcagctcggccaggctctcctcgtccagccgtgtcaggttgttgaaggacaggaccctgaggaaagggagggcagcaatgtcaccatctagtgtggttgccccccaaccccaccccaccggaaattgggccacagtcagctgggtttcagtgggaaatgacacagatgcacacgcacgcgcgtgcgtgcacacacacacccacacccacagaatcctgggggtaaaagtggccatgcagctagaaactcatcagtgcccaacacactagtctgactcgtagaatgggtgcataggtcacaggggccagggtggctgttaaactgtgaagactacacacgaggtcatgacacacaacaactctcaagctccagcgccttcatgctgtccaaggcagctcctgattcaggctacaaaagacctctctcatagcagaagcctgggattctggagatgaccccgcagcaagccagggagccccagtcacactccctgcatctgccagcagagggcaccactagcccctgcgtgggacaaccacacctgtgcctcatgccttagtggggcaactcccccagggcaggaggctcctgctcaggcctccctgcccccatccacgtggacctcagagcatgatcccctactgcaggcggtaaaagcacatgctttgcccgaacctcagaatcaaagcttcctcccagcactcctgcacctctgggttgcttacgtgacatattggtcatctatcgttgaaaaattggggctggggcagggataggaagatggaaaataaactcagagaagattaatgagcttttaaaggcagctaggagcagcattctttccctcctggacaaataagtcagggtgtctgtcagttaaacagacctggcaggagatcaaaattatatcctcacctgcaattaaagaatttagcttaaaggaggggtgggaaacacatgctgggaagcaatcccaaatctgcctctgaggttacctggatatggtgcaaactgctaggactgctcaagcgcacttctgtgatctttgctgccccttctagagggcatggaagagggcttcatgccttccaccagctagagaggggatcccggaccccgcagaagacagcatgccatccctggggccacgatacactggtgagtcagaggatggcccctcactttaagaattggactggctcaggcttcggggacttaaaagacctctcttgcttcccacacctcccggccctgaccaacaaaaccaggagtcccctggtggggtcacagcttgactacagagcctgaaaggagccatccagcaccacatggaatgcacaactgcaggccctgaagcgtaggaagctgaaaccaaagggttaacactcacagaatccaagaaaagttaggaaagaggcaggaccactgtgttttgcattagataatgatggagtcaccaaaatataaactccaagtcagtgtgtgtgtgtgtgtgtgtgtgtgtgtgtgtgtgtgtgtgtgtgtgtggtggggggagggggggaggaggagggaaggaaggacagggagagagaggagaacacagaagaccagacacaaacaccagctgcaagaatccacattagattcacgcatccccttgagtttgcctggtgaggtcaagagagagacaggacagactgaggcttggcactcttaacaatcattcacttcagtgggtgaattttttccaacagccaagcctagaaaaggaagaaaaaaacaaaacaaaacaaaaaaacccacccaactcttgtgaaaaataaagaaacacagtagactaaactggagcatatcaaatggaaagaacagtgaaaacacaaactatagacttgtaaagatgttctctgagtccttaggaatgctgcgttcactgtccagtaaccccaccctgacatgatggggtggccagggccactgcccatcgctacccaggcgacagtctgtcactactaatctcagaactttgggcaagacaagctcagttctcagtctcaacctgggacccctgtctggaaatctccaaaaggagcaagaggaccacaccacacatctctgaactaagcacgcacacgactgcacaggagcctctgccagcaggccactgcggtgcaaaacagagaaagggaaggggccaagaacctgggcagctcatctacaggaaggaaggtggcgactccgaggacacaaattcatccacagtcagcgtttcactgtctctgtttgagcccaaatgaccccctcactgaagaagcacatgctatttggtgtggccattaacacacagtcactctcaaaatggctcctgtgagcactctgccatagctgcccttccccaggaactttctacccctggaactgtctccaaacccaacaggaccttgggggccaaggctccctgcagggacctagctgctactcctggagcccctgctaatccaaatgcagaggaagtgaaggggagatgaggaagggactggggctcaaatcgctgagggttccaccctgggcctggctggtttgggaacagggctactggcctgtctctgagccctccccgaggccactgtgtggtggaacgaaccaggcctagcactttcacctccaagcagtgtctaaaaacactgccacagcccagagccgaggacacttacaactcatgcagcttctggcagaagctccagcccttgcggtgaatgcgagcgatggaattgttgctgaggtggagctgatgcagggccgtgaggccgtagagcgagccgctgttcacttctaccaggctgttgtactccaggtgcctgcaatgacagccatgcacaggatgaagaggagctttcactcccttcactggacagacagcaaatgagcagccacgctgtacctgacactgcggtcacaccaaggctagaacagtgcacgacagaactgtggagtctagtcgcacacatgtgcatgtgagtaggggctgggagaagacaggcaaatcaaaatggatgacagcacatgccaaggccgactcgagtgttcatagggcaagagggagcttcctagaagtgacttttttggctgagtaaaagtgaaccagggctgggtgtggcggcttatgcccatccagtacttggggaggccgaagaaggaggatcgcttgagctcgggagttcgagaccagcaagggcaatatagcgaaaccccatctctaccaaaaacaaaacaaaaagtgacccaggccaacaaacgggcacaggagttccaggcaagggcaaagcccattaaaggaatagaaaggagagcgaataggaggcggctcttattatcacccgcatctcacacatgaggaatgtgctgctgagagaagccaggtaacctgtctaagactttacacagcttagccagtagggaaggggctagaattaattcaaccctgggtctgcctaccaaaggctggactctgtgccactgtgctaggagacccgctttagctctggcgtcagactacctggatttaaatcctaattttgcagcttgctggctgaataaacctgcacatctactaacatggagatatccaagagcactgactccatggggtcactataagaaggaaacaagggtacatcaggattcagtgcagctctaggcctgagctctcaggcccaccgtgtaagtgtgctagcaccccgcttcccaacacagcatgtgccaggaaggacagcgccagcccaggcaaccgcctcttcaacaaaagtccgtaacccgaattttgctccgtgttcagtattacaagggctttgggtaactgagttttgcttttttccatctttctttctgctactgctcaaaaggtaagcacttaatgtataaataacctctaaggcagctcatcagtctcaatttatacaaatctgttcaacataaaaaccaaatggtaggtgctaactccattttcctctgagaattctcttttaacttcagtccacccagcacatgaccaccttggacttccaagtccaaaatgacatgcctaaggaggtcaagtgaaacgtttttgaatatgtaaaacaaagggtggagaatgggtagagcaagaagcccagcggcaggaaacatcctcactgttcacagagtagggagggctggtcatgcagagacggttatcagagtgacacagcacaacatgtggatggacctgggcctagctcgtttccactgccaagaaaaccagtaaaggacattcgagtcatgatataatttgcccagactggaagaagaaggggcggacatgagcaagttaaatcattgactctcaaggaggaaatcgcaagtggataagtaaagacagtggtgtcagtctatcaacttggaaggaacaaccagcaaagctaaaaacagaaaaacgaaaaagagaaaggcttagaagtgcttgcctcttgggagaagaactggggtgaagagagaatgagggggtggtggcgggggaggctggggtgggcagtgatggcttttctttactatctgattttatttaactatacagtcaaattacttttgattaaaaataaatattaacgtttaaaaaggctttcaacgtttaaaaagccttttctgtatgctgccctgctgtttcacgttaccgtgcaggcaagccccttctgctgctgtacacatctggctgaagagactgctcccttgataaaacttaaacatctgcacccagtgtcttgattagctcacaagacagaaataaacctcctaagatgagctctacatttttggcccacctgcacctcaggaaagactgtcaaacccagaaggggagagaaggaacttcctgtggtcaggagtggagaggatgtgaggaggggtctgttccgcagccccacgttcaccgaagaagcaggggcgggggcagtggatgcaagctgtggaaagcagtcctggcagaatggcccccaaactccatctccatcaaccaacttatctgactcaatccgctgaaacttcccccaagtggatttcagtggatgtcccaatctgctaggaaaataccctcaggtttggcccggtccccaagacaatgagttgggcccaggtgaagctgcaaagggaagggggctgggtccggctgaagtcttgaagaatccttcaggagagaggggctgggcactggtgccccactccatgcccagtgcacagctgaatgctggtgtgggcgcgcacgtgcacacgcgcacgcacacacaccccacaccacacagcaatgctggtgtgggcgcacacacccaacacacagcaacgttggtgttggtgcgcacatgcatgcgcacacacacacacgccacatcacaccacaccgcacagcaatccttagcaatgccagtaacctggtccgcacttacagcacatgcatcttggacagtccccagaaggccccatctgtcagtttgctgatgttgtttcgctgaagcttcagcacctccaagctgttgagcccctggaaggtgaggccctctatcagccgaatcctgttccgattgaggtccctaaagagatgaagccagcagggtcagagtgtcttatgtgcatatcccacccacaaccattctgaagcagtcctggctaagtttccaagccagaggagaaatcccagtgcagggatccctgggaagccaggatgtgtaggggagcccaccatgtgtctcggctgccatgcaggcactgatgctgccacctgaccacacctagtgcaggcaagaggggtgagtgaggccagctctccacagccagctccgaggctggcccacagctgcacagaagagaacgcgtgtgtgctcacgtctcctcccccagtagcaccagtgccatttgtgactctgcagtgaggacgtgggtatgactcaaggggtgaatgtcttatgtgaggtatctctgagctcagcaacagaaatccacaccacatgcctcaacccaggaaaaaccaaaccactatgtatcaaatggcaataacactttccactgggggcatttcacagcatctccactatggagagaagttactgcacatgggggcagggggagatggggtagagacaccccacaagtcatatacacttggcttctagccccagtatgacaaagcctcagttcaccaaaagatgtcaggaatctgggtgggccagatccattagcacccctgcgggaaggggaggcagagcagccagaaagcccttggttttccccaaatatttctgcagtgtctcatgatgctgccccacacaaaccttctcaggaatcactgagaccttctccacagactgaaaatggcaaagtctaggactccccacccaggggaggtgaaacccaggtaggatgagagccaggcacaccccgtcgtgccgccaacctggccctcgacaattattttgttttgttgaaacaaaatttccaatactgtcttattttcctgaaatacattcttctgctaaaaagagggcacaggaaaaaaaaaaatcagggaaaaaaagtccttcgtcaggctctggttaacagagctttacttgaatctaaaactctgccttctagaagggtactcagccttccatcagtaaactaaacaattaaattgtttacaaaaataataaatcggccgggtgcggtggctcatgcctgtaatcccagcactttgggaggccaaggcaggcggatcacgaggtcaggagatcgagaccatcctgggtaacaaggtgaaaccccatctctactaaaaatacaaaaaattagccaggcatggtggtgggtgcctgtagtcccagctgctctggaggctgaggcaggagaatggtgtgaaccccgggggcggagcttgcagtgagctgagatcacaccactgcaccccacctgggggacagagcgagactgtcgcaaaaaaaaataataataaataaataaataataataataataaatcaactaccttgtaagattaaagatatgaagacaaaggcttgtcttttgcttactaactccagctacactaacttcctctcaaactgttcaagaagtgtcggacaccaccatgtccaaggtacagattttacgggtatcttaaaaaaatacagaaaaacatctaagataaataagaacccaaacccatgcagcctcagcattagccagcatcagctaagcagcaggactcctgattccattttggaaaacatcagggaagaaaagcgacctcagtggatgtctttctcagcaacctgaagcagccacagcaccagacccagctccgaatttgcttttatgaggtgctgccattaatggtaatttatggagagctttaccaaatggagcaaggaaagggtggcgtttggtacgaggtccttggggaaatctggcctccataaagtttggctagccttaattaaagtgtaggtttctgtactcacagttgtgtcagcctgggtagcttgaatgctcttacaggaagctgggtgatcctgtttttgctcaggcgaagagttagcagcgaccgtgacagaccatcaaatgctcccaactccagggtgccaatccgattgcctgccaggttgctggaatgattcagaaaagaaaatgtggtggttggtcaaaggccttcctcatttcattatagacaccagacctctctgggtctgagttgggaagatgagttaagacaccagagggacaggtttccagtgagatgtttatcagccacaggctttggatggggagctagagagatgcaggtgttaggactgtgcacctaagccctgagggcaaggccgatttagtcgaaagcatactgtccttgaagctgctgggccaccccaagagggtgggagtgaaagtcaaacacccccatgcccactgacacaccagccctgcgtcaggagccacctgcaggactcttctcaccacccagtgcccaaggttgacgtgaaaactcctagaaagcagaaaatcaactgaaaggcaaggtcagtgttaatttaataatttagagaaatagcctttagttttgaggtgggtcttgctatatgaactacataacacatatgtataaaccaattcatttctgtaattgtaaatgcctcaaagaaacactctagctgaagagacctgtgcagaatcccttcgtaaaacaagcaatatgtcatggtacctacacttacagcgtgattaagtcggggcatctcccgtgacaatacaaaaaggcagacaccgcttctcaaaaggcacagaagtctgcagctcagatctgtgcatcttgctgtatgcaaattatatcaagtaataaaaaagaaaagaaagtacaaggaagaacaatatggcattcctgtgagaagtggtttccaacacctctcctctgccttccccaaacaaatgctgctttttctggcctaagtgaaaaggagaaagaccagagaggattttctgccacagagggtggaagggagcaaggcactttttgtctctccagcagatagtggcctaggacaaggcacataaggattctttgcaaatggggctggactgtttgttctcaacacctcagattaaagaacagcctgtgtgatgaagatatatcacccaatagctgccaaaatagaaagtccctcccacttttgtgcagggagaggtcagagcaacttagtgtagcagttatggtttctctgtcccaagcaaagtggtgtcacgtggacaccttttgagggcccacactggaggcttcacaaaagccaaggcctcctgttcccaactctggcgccctaatgcaggctaagaaagaaatcactcttcttcttgcagtatttacttggaaaatccatgtgccaaacctcaccctccctgaaaagatgggtcacaatgacccctaaaccagccttgcgaatgcgttccaaagttaactctggaacagtaatgacacacggaatgaaaactcacctggaattggaaaacgtctctttagcctggggttgcagtttctttcccagagtaacacttttcctaccaacaagtagttgattaagtaggttttaactttttttccttcctgtctaccatccattgtgtgtgagatgggacattaatatgggtaagagaaacagacaaatctaaaaggtgctgaaaacccacataatagagtaactgccctcccccaaacaaacccaatgacttgttttacagtgcatgacactagaaagataagcactgataagctaagccctgttagacaggcttccaatgtgaatcctctaaccatcctccctgaatctcctctggaagcatttctgagaggcagccaaggaaatgggaaaaaaagcaggctttgtggtcaagatcgatctgttcttgagtcctagactctcgtcttggagtgctgagtccttcctgcctctgtcccttgtctgtctgtaatgtcaggataatgctgcaggatctggacgtgctctatgcatggggctcgcccctgccctgctcagggaaggtctgaaccatccccactgactcggcccagccgtggttgagaagggaaggaagcatccctcctgcatccagaactgggtgccggtgaagctgttagctggctggacacagcgggccagccacaggtggcagaacagaggcacttacagctcctttataggcggtccgtgtggaaagcaggtgttccgcacttccgtgatgttgttcaaactcagatctaacacttctaaggaaaggtaggccttcagctggctcccctccacgctgcgaatcttgttgtgctgcctgaaacacaacaagggaggtgacttgagcatctctttttgcaaagtaactacaagaaactagtattcctgcaccccaccccccaccaatataactacaatgcagtgacgctcttaaaaatgagatctcctgtttcttttcccatcaagttattacctgctggccagatgctaggagaatattggattttcaatctgggacaagtttatcaaagttctatccctaggcttccctctccaagggcaacaacacagcagtgacactgaagaccatgtgagaccagcatgacctgaccagaatccacggatgcactcaccataaaggatgtgccctgtcctgtgcagccagacagctccagtccaactctcacccatcatcctcagacctagtccagcctcataacttacaagagccataggcaccacagcccagagttcactttaatccagtttaacacatcattacacacctcacattttaccaacacctaccatataccagacacagaggatttaaacaaaaagaaaaagaaaaaaaaaaaaagattacgacaaaatcctgacaatgtaaaatgggaaagaggagctcactgctgagtctaactgaaattgagttccctgaacctcccgactctaccattaatattaagcattgtgcctcggttttctcatttggaagatggggccacaacccatcacttcagggatagggacgatccagcctaaaaccacataaagcatgtggcaaatctgaaggtaaatgtttagtggtcaccacctcccaagacaggaatgttccactgtaacttgtgttttttttttgttttgtttttgtttttgtttttgagacagagtctcgctctgtcgccaggctggagtgcagtggcgccatcttggctcactgcaacctccgcctcctgggttcaagcgattcttctgcctcagcctcccagatcgctgggattacaggcacgtgccaccacacccagctaattttttaattttttttagtagagacaaggtttcaccgtgttggccaggatggtctcgatctcctgacctcatgatccacccgccttggcctcccaaaatgttgggattacaggcgtgagccaccacagctggcctgtgcgcacctttaatctactttctgtcaaacccactatataaacaagcaacagttataagtcaagagaaagacgaatgctagccaaggctagaggtagctaaccgccctgttgtgggtttggcgccgcctggcagagtcaaaccactgcagccctcactccaatattagacacttaggaatctgctgggtggtggcgctgggcctctaggttgcaggcactggcactcgagccagttctgaataaacagtgtcagcatctctggccaatcaaagcattcttgaacacaacacaagtaagccaggcgtcgcttaccaagtggcatctcctttaaacaaacacttgaccgaatcagttccaacaggcataaacaaggacctctttcccagaagctctggggcttctcgtggactcctttgtttttttcatgcgtctcccaggccctgaactcgaaagtccatttccaagggtgcaactctgcacacagaacctccccggcatgaaaggaccctttcccttcctctcctccccagcccccaaagccacttcctttgagttctttattaagttctttaataaagatagtctcctcagttttctggctccaaaggaaaaaagaaaagaaaacctttattatgtaaagtatgggaagaaaagaaacaagaaataaaggcgacagagctgagtcttatccgggaactgtgaatgtggtatcagggcgccaggaaaagggtctgtgctggacagaagggccgggcgccaccggcccagaaaggcacaaagagggggtgaggccttacattgcgaagccgtgggacagctgcaggcccaacatctctcccacgccagttctgtcctctccccacctcctcctctgtctcctcagtctttgtctgtggtccggtaccttttgctccttgtcagtcttttcattcgctgaatcaaacacaatccgggccccactctgcataaaggaccctgtgcagaagacaagtctctttcacccgctgggaaagttccccatttggcagaagaggcagccgtggagatgggagacaagggtgtgtgggagtgagggccacagtggcagggtctgtgagaggagcaagggagtgcacaaggtgccagggcgaatgtctgagggtaggatgctgaggccaggaggagacaggtaggcagaagccaggagcttggatcagattgcagagctagtagggtgggcaggaccacaacagcaaatgcctcgcagcccaagctaacaagttgggaatggatgccacagtgggccaggagagagatggcggcaatacagagacaggcacaagagaccctctgattaggtcctacccaccctaccagctccaccctctgatcaaagctgctggcctctccccacctgtctcctcccaacttcagcatcctaccttgaaacaccctgccctggtgggggctggagatgacaactaggggcatcaataatgattcaaaatgttctagcttggaaatggaagataaccatgcccatgggctactgactagaccttcccttccatccttgcccacttacagtctattcccaacccagcagccagagagacccgctaaaaataagtcacttcaggcatcccacggaataagagaaaatatatgcaaatcacatttctgataaggggctaatatccagatataaagaacctctacaacaacaacaaaaaacaaccaacctgatttttaaaatgagccaagaattgaacattgttccaaagaaaacacacaaatggccaagaagcacatgagaagatgatcaacatcaccattcattagggaaatgtaaaccacaaccacaatgagaagtcacctcacacccactaggatggccactattaaaacaaaacaaaacaaaaaaacaaacagaaaataacaagtgtgggtgaggatgtggagagagtgaaaccctgtatgccagtggtagaaatgtaaaacggtggtgcacctgcagaagaagacattatggagattcctcaaaaaattaaacagaggcacaccatatgatcccacaattccacttctgcatatctaaataactgaaagcagacctcaaagagacatgtgtatcctcacattcatagaagcatcactcaccacagccaaaggtggaacagcccaaatgtccatcaatgttgtatatacatgcaatgagatattactcagccttaaaaagaaaagaaattctaacacgtgctactgaatggatgagcattgcggacatgatgccaagtgaaagatgcctgtcacaaaaagacaaatgctgtatggtccacttatgtgaggtagctagagtagtcagatccactgaaacagaaagtagaatggtggtgtccagggaccggggagaccgcagaaggaagatctgttgtttaacggtgtattagtccattttcatgctgctgataaagacatacctgagactgggcaatttatgaaagaaagaggtttaattggactcacagttccacgtggctggggaggcctcacaatcatggcagaaggcaaagaagagcaagtatgtcttacatggatggcagcaggcaaaaaaaagggcttgtgcagggaaactcctgtttttaaaaccatcaggtcttatgagactcattcactatcatgagaacagcataggaaaaacctgcccccataactcaatcacctcccactgggaccctcctatgacacataggaattgtgggagtcaattcaagatgagatttgggtggggacacagccaaaccatatcattctgcccctggcccctcccaaatctcacatcctcacatttcaaaaccaatcatgccttcccaacagtcccccaaagtcttaactcatttcagcattaactcaaaagtccacagtccaaagtctcttctgagacaatgcaagtccctctgcctatgaacctgtaaaatcaaaagcaagctagttacttcatagatacaataggggtatcagtattgggtaaatatagccattccaactgggagaaattgaccaaaacaaaggggctacaggctccatgcaagtccaaaatccagcggggcagtcatgtctcacatccagatcacgctgatgcaagacgtgggttcccatggtcttgggaaagctccacccctatggctttgcagggtatagcctccctcccagctgctttcacaggctggcgttgagtgtctgcggcttttccaggtgcccggtgcaagctgtcagtggatctaccattctggggtctagaggacagtggccctcttctcacagcttccctaggcagtgccgcagtagggactctgtgtgggggatcccacactgccctagcagacattcttcatgagggccacaccatatttcccttccacactgccctagcagaggttcttcatgagggccccgcccctgcagcaaacttctacctgggcatccaggcatttccatacatgctctgaaatctaggcagaggttcccaaacctcaactgttgacttctgcatacctgcaggctcagcaccacatggaagctgccaagacttggggcttccaccctttgaagccatggtccgtgctctatgttgcccctttcagctacagctggagcagctggaacacaggacaccatgtctctaggctgcacacagcacagggaccctgagcctgccccacgaaaccactttttcctcctaggcctccaggcctgtgatgggaggggctgccgcaaacatctctgacatgccctggagacatattccccattgtcttggtgattaacattcagctcctcattacttatgcaaattcctgcagccagcttgaatttctcctcagaaaatgggattttcttttctattgcattgtcaggctgcaaattttccaaacttttatgttctgtttcccttttgaaactgaatgcctttaacagcacccaagtcacatctttaatgctttactgcttagaaatttattccatcagataccctaaatcatctctctcaagttcaaagttccacaaatctctagggcaggggcaaaatgctgccagtctctttgctaaagcataacaagagtcacctttgctctagttcccaacaattcctcatttccatctgagaccacctcagcctggacattattgttcatgtcactatcagcattcttgtcaaagccattcaacaagtctctaggaagttccaaactttcccacatcttcctgccttctgagccctccaaagtgctccaacctctgcctgttatccagttccaaagtcacttccacattttcaggtatgttttcagcaatgtcccactctactggtaccaatttactgtcttagttatttttcacgctgctgataaagacacaaagactgggcaatttacaaaagaaagagatttaattggacacacagttccacctggctggagaggcctcacaatcatggcagaaggcgaggaggaacaaatcacatcttacatggatggcagcaggcaaaaagagagtttgtgcagggaaactccagtttttaaaaccatcagatcttgtgagactcattcactattatgagaacagcacaggaaggacccaccctcataattcaatcacctgccactgggtccctcccatgacacatgggaattgtaggagttacaattcaagatgagatctgggtagacatcatcccagccaaaccatatcaaataggtatgaagttttagttttgcaagatggaaaaaagttctggagactggttgcacaacataaatgcatttaacaccattgaactccacattttaaaaaatacttcagatggtaaattttatgttatgtgtactttaccacaatttaaaattaaaacaaggccaggcacggtggctcacgcctgtaatcccagcactttaggaggctgaggtgggcggatcaccttaggtcaggagttttgagaccagcctgaccaacatggagcaaccctgtctctactaaaaataaaaaattagccgggcatggtggcgcatgcctgtaatcccagctactcgggaggctgaggcaggagaattgcttgaacctgggaggcagaggttgtagtgagccaagatcacgccaccgcactccagcctgggcaacaagagcaaaactccatctcaaaagaaacaaattaaaacaaaatgtgactcagttcacagcactcctctgtctaaatctcaaatgatgattcttgtgtctcccaagtaagtcctgtccatggtctccaaggcacatgtggagttcttcctgctgtggaacatggcacagcactgtggaacaatatgccttgagtgtcttcctgcccaggttcaaatcccagctatcccactcacaggtgtgaacctcagaagagcccctctgtaaagtgatgtgtgaagttcatatgccccatgggctgatatgacctgacacgtaacaactgctcaataaaatgagttcttgtttttagtagtcatgcttgtgtcatcagagccaggctaaggatctagtctgtaggaggtgctctggaaaaaagaataaaattaatgactggttcttgtctactcttctgacatatttcagtgcaaacaagcagctctggctcccctctcaggaacgaagggctgactcagagctctcactcttaacttcaagcataaaagaagcctgctccagctggagagtgtcaaacccagccactgggaagaccccacgtttcaaagcaaatcccagactgcaacttctgcaggattcagggtggctagacatctgacagattccccagcatctggatgacaccccccacccccactcccacagcaagtggaactgaggccacgtccctgacccaagcccaccaaaccccaccaaccccaccattccagaggtagcctgctggtctaagataccctctctaggtctcccccccatgaaggttagagtaaacagctggcattcaaacccctgcagggaagccttcccacctcctgcctgagagttgatgccatggaaacgtgtctgctgccctcgctcaacccggcattccaccttcaggaaactatccatgttttcaattccacatgcaaacccaagtggtcatcattttcactcctttaacataactaactgcacagttcccaagaagatccatacctctttttattgcctctcaacagctgaccaattaatgaacacctattatatacacagtagatcctgggcaaagcatcaatgccatcacacagcaatctaacaaggtaggtactattatctttataggcagcccctgacttacgatggttcagcttaacgatttctggacttcacaatggtgcaaaagctatacacattcaatagaaattgtacttcaagtacccataaaaccattctgttttccactcagtgttcaataaattataggagatattcaaaactttattataaaatgggctttgtgttagatgattctgcccaactgtggactaatatgagtgttctgagcacatttaaggtagactaggctaggttgtggtattcaggaggttagaggtattaaatgcattttttgcttaatgatattttcaacttaggatgggtttatctggacataactccattgtcagttgagaagcatctatacttaggcaattgaagaaattgaggctcagaagtctgctggagcttgcccaaggtcacacagctgggaagcaagaggagccgggatgcaagcccagggaagcatgaccctatctagcccgtccgagaggctctcctggcagaactttaagggcactggcccagattccacccataaacttccaaagcttggctaaatctgaacattagctggccatttctcagtcaactcagcctgttctacgtagcttggcctcggccaggtggcccagctctcatacaagcttcccagagtcctgtgtgagaagcaaatgtgcacaggacttcatgtgacagaatctcagcaaataaggcagataaagctcaagtttttactttgaatgttctggatggaaagaaaagggcagtttctttgagatcttgaaagatctgccatcgagggaggaaggagtatctttattgttagggaaggtaagctgcaaagggatccacttaagtttacaaaaaagggtgaggatggtgcaaggcaagaggacagtgttgtgctaggaacagttcttattggcctcatcaaaggaacagcgcagcctttctctgcaaccagacaaaaccagtgattctgcacttatggggaccgggggaagtgtgtggtggccaggtcacgtggcattcgcctccatccacagtgtcagtttaccccttgggctgccctctggagcgaggagaacttaatacagcagaagtctattaaaccaacacctgttaaaggcttcaaaaataaaatcagtcttcaaaggcggaaagcaggcaagataagctctccccagttggctacattttcagagctgatgttaaattagacagtgaaacagatggaggcatttgaaaccaacatttaaaactttttctcataagtgattgttccactacagttctgtgaaagcctggtttacaaggtattcccgttagtggtggaaaagatctcatgtcacagataacagccaggaagaaagggcaaggagatcaaaggcagttgggacaaggtgggtcaagtgggtaatttctgacccctgaaattatgcacctattttctacaccaggggccagcaaacttattctacattgggccagatggtaaatttttaggctttgtgggtcatactgtctctgtcatgaccactcagttctgctgttataatgtaaaagcagccagacaatatgtaaatgaatgagtgtggctatgttccaataaaactttatttacaaaaacaagcagtgggccaggattgggaccactgtctgtggtgtgctgaccctgtcaaccctatggcaaccagtttgtgtttcttggggtgcagagacccagactctaattcttgctgtcatgcaattttggaaccatgtataaatcactctttctctacctcgtttaaccacctgcaaaataaggaaatacctcttaactgcagagagaaaactttcccattgtccctccagtgcccatgtcagacatcactaatcacagtcttttctgccaatgtcttttctacctcttcagaaagtgaaatggaacataagtctctctaccactgttatgttcctcaagagatcaaccaggttccttactggagccagtgaagatagatgggcaaacagggttactttacagaagacagaaatccacactgtatatcctatatccttcctcgtttcagttccgccaattagtctgaaacatactgaagctggccagctctccatccctaagatctaagaagctgtgcccttccgcccttccagacaattacagtgattcacaaagtccacagtcaactatctgagtgtggactctcaccgaaatggcaaatctaccacagttttacttcaagatcaaatcttaacacgtcttacttaatgaataagcgaaatccacataatagctctttgcttcgcctgaacctccggttagaaaataagtttcacataatctagccctagactggggggaaaaaaaatctaacacccccggcccccattaccccaacaaagtgatcctggcagacaggtttcatcaaactccacaccctgcagcactctgcccatcatggtgctgcactggaattcttaccaaggctctgcatcacacactcactgtcaccacccacatacagcacgcactcaaaataatcaaaatgaatgaaggcgtgcacacattcacatatgccttctgaggctacagtgtatcttaacaacatatcacacctggaatccacacaatgtgagactatctgagaccctcatattactgacggaagatgaaacttagtacagggcacaccagccctgatgcctacctaaggaggtgtactttatgactgcaaatgccaaaaaacattaaccatttcaaaaacacacatgaaggtgatgatttctccttgtcagaagacacaggctgggcacagtgactctggcctgtaatcccaacactttgggagccaacagtagaaggactgcttgcggccaggagttcgagaccagcctgggcaacacagtgagaccctcatctcttaaaaaaattttttttaaaattgcagcactatcagacaggccatatggccaaatgctggcagttgttttgtttgtaaacatttttattgaaatataaaggatttttacaaaatgtagagaaaaatttccgcacccagaagcctccctcctcctgtctcctggttgttattcctcccaaaggaaacctctaatttctaccacccacaattaattctgcctatttctgtgctgtacagacacaaaactgttctgtacatacccttttttatttggctacttccactcaacattgtttatgagatccatctgggttgctgcattagcagtagttaattcttttctatcactgtacgatatttctattgacagaacatacagcaatttattttttctttctattgttgacggacattgagttatttccaattcaggctattgcaaaaatcacagctatgaacacggacttgtcttctgcacttgctttctggtgcatgtctgcatgcatttttggcaggcgtgcaatgtccaggcatggaattgctactcaggtcattgagcttgcatatgtctggccttagcagacactggtagttttcttttaaatcaagtcccccagggttgaaatgaatctgaaaaccattagctccaagtgccctgtttcatgctgcttcatttgaccacattctcagatgccactgccctcatatgtcccctttctgacccctccccaaaaaacacattaggaatatagcctggggccaccgaacatggccaagctcaatctaatcttcttcaggtgtccagtagaattttttaaaataagtgagggcctaatgatcacaaaaaaaaaagaataattctaagtctcaaaattggcaagaaataatgttgatgctaaagtccacagcttacgataatgcacttgtgccaggaccaatgcccatacagaacttgaaaattaagatgagacatttttcaagaacaagtgaatgcggaagagctttcctaatccaacttgaataaaagtctcccttctcagaatgacagttgaaaccatttccctctagcctgctttacatccatcttcttaaaaattaaaatcaaaatcatttgttctattgcagaaattgatcatttactcaaagaactgctgtctcgtaagaaacagcccagcctgggttatttgctggacaggaaatgagaatcagaataagcaggtctctctctcttgcttgttccctctctcttcccctgctgctggtgaatcaccagttccctggggaattttggcagattctcagcctggctgcagatgacgttccagatctgtttattcaggtggagactggataaaaaacaagagcagcccagtggcgggataaacagcctccgccaggcagggtcaacctctccaaaggcaggactgggctgtgtcaaccaacctcccaacccgttcacttcctttagggtcaccctcccctttgggtcttcaacaaacagcttccattaactccttgcaaagacgacccaatgtcccatccccatgagactacctaaccccagggaccttgctacagcagatcccatttggttctcccacccatcaacttacacccattgaactgaaagccccggatccctgaaacgaaaaaatctaggtacgatcaacagctggccaccactgttctgtgaagtctagagtgacccaactcatgaatgacccaggacccaatccaaactatcagaatgttctgcatttaagatgcacaaataaacaagagcagcagcaaaactcctaaggaaatacacattgttgagtaaaagatgcccatctgaaaagactaccaattgtatgattccaaatgtatgacattctgagaaaggcaaaactatggagacagtaacaatatttaactgccagaggctgggtagagagagatgagcaggttcagcacaggagatttttaggtcagtgaagctattctgtatgacactgtaatggtgggcacatgtgattatacatttgtcagaaccaagactgaactctaatgtaaactataaactttagtaataatggatcgatattgactcatcagttgtaacaaatgtaccacactaatgcaagatgttaacaataggggaaacagggtgggtgtgtgtgtgtgtgtgtgtgtgagggggagagagaagagatggcgggggcatatgggaactctccgtactttccactccatttctgtaaacttacaactgctataaaagtccattaattaaaaacaaaacaaaacaaaacctcctaaagtattaagtagtcctgcagtctcgactgggtagaatataaaccgcacaccggctaggaatttttagtctatcgtattgactgctatagccttagcccccagaataacgcttagaacttaaaaggtactcaatcaatatttgttgaataaacaaacaaattacaactttagttcaatgtcttacattcaccacaacaaacctgaaccaaggaacattactcaggaaaaacaaaacaaaacaacaacaacaacaacaaaaaaaaaacactgaggcaggaccaaccatccaattaaaaacttttaaaaagaaaaaaatttaagacacaacgtggagttaacttttttaaaaaaggtagggaagctgacagacctatttaaaagcaaatgtcgaatacgatggattttcgattttcaaatagcacggggtgggggttacttacgcatttcccacattcaattgaaccccaaacactggccctcactggcttgcaatgttgagacaattatgcttatccaaggctggccaacaatctctccctcactcacttctagccacagctcggccctgcctgaggtccccatccacacgcctcccctgggagttccacgtggacactgctgacccgaggaagctgtacaagccacatatggatcacattcccagggagaaaggctatgccatcctaacatgggcagtgacttctaaggggcttgaggagttagttccatgtccacacggaggtcagctgtcttggcatctgggcatggcaaagcagtaccaggttgggctaagagatgaaaaaccaggctcaagttgggccagagatggacaatgagccacttccaccagaattcccagccacatatgcccacctctgggtcagaagagccaaacgtatttatcgcttttgctcagggccaacatagacacttgcttctctctcagggctgtgttttcccccaaatgtatcaatacatccctattttcttccccctttgttttcctttccctggtgacctgctaccccacaccccagcacactgatggtgttccctccaccacaccgagaccccgccacaagctctcagccctcgtagagcacaggccccaccctgaaagttggcagagcaccgggctatcaagctgtgtcatgtggagccagcaagcccggcacaaccgtggatcccgggtacggcacagctgaactgaacccctctgatttccctttgagaagaaggctaaacatacttcattacaattgtcagggcacatgtgtccctgcctgttcagctctgccccttgagggaaggaggtaagaaaaccaggacacagaatgagagacatggattcaaccagactccaggggctgagcaactgtttctggacaagaaaagcagaaaaggtgagatggcaacgatcaagaatgaggtgatgagagtgtcccttaaggccagggactaaccccagaaattttaaccaagaagcgtccgcactacccacgttggagggtatcaggaggctgccatgcatggttttcttccaaagaaggctccgccaactagggtgaggtgggaagtcccgagcccaggggtgtgaaatgatggagatactgcacttcacacagcaaggacctcctctgcccaagttccacagggactggtcagcaactgggggagggggtcacccaggagtccaagaccaatgagctctgacatgagctattgtggtttctgttcctctgacctcaccaactaggacctgaaaaaatggaaccactgttgagaaacatgctgacctcacgccaaattcccaaagggagcagaatgaacctccttctcacagccacccttccatctcagccttgggcaaagcggtctgcagcactcacacacctggagactgtccatgccaccatgctaaaccaaaagcagggcacacagcccaccaattcacatgactgtccctctctagaagatacacgtagaaaaaaagatagggaatacaggatgttgttctcacagtacgatgataatggaatccccaccccattttgcatactgcctgtcaattatgtgacattaaatttatatttacaaagcagttaatgaaaacgtagacaatgaactttgggacctaatccttaagtgcagagcagactaagaagtgtggtggagagctgtgtagggttggtacagcccagggtggcctgagcattccaccaccagtccaccaggcacaaaggagggttttccacacagaacctcctcctgaaccccctgcccccgacactctcatggcacaaaagcctgctccaggtggtgcaaacttcaaagggcctttgtagccggagtctggaatggagccctggtgcttctgcggcctccaggaagtggttccaatgctgcacagggccatggatgtccagggagcttgcccttgatgcttagctatggaggagtcacactgcattttctttccagtagaaggggtggcaggagtagccataatggcaggaacagtgggaacaaatctaacattttgttagtgcttaccagtagctaggcgctggcttcgctcttaacatcttccctcatttaatcttcatgacaaccccagaggcggccactattaccgtccccattttacagatggggatgctaaggcacggaaaggtcaactcacttgctgaaggttacacagcagtaagcagtgcagttgggactggagcccggaacaggaatccatatcccacactcctagtcaggatgtggaactgcctcaccagggaagcgggcagaagaaacctgaggaagacagcttctcttgatagcaccccatacctcccacctcttctcggcatccaccagggacagggataaccctacactggggccacaccatgtgactggagcagaggcaggacctgactctgcagatacagagggaacaagaaggggaatgtcctgtcgcaagccactgttcatccccagtcctgccaggggcccacacccacacgtaggcttccaggccctcagcccacagcatgtcaacacagcattgccagagggcccagccagaccacctctatttatatttaggatgactggagtggtcagcggccatgtccccatcctaaacaggtgggtgagagtggctcttatttcctcaggcagtaagtataaaggcacagaactgagcactctccagggaacaaaagaaacttgttcgctcattgcttaccaccacgccagagaagccaccacctactccagaatcagagaggttaagaccctggtatgaagtcacccagctaaccaagatgcaagcataggtatcctctgactccaggctgtgccgctctctggagtgacagtggcacagtaagccagaccagacagcctgcggctatgaagacagagaggggactgtgggtgctgcagcgctaaagctccctctgaggttacacatgggcccctcacctctactggccactggcacattccctgagattcacatgccagcttcctgacagctctgcagttccaggcaaaggaggaagctgtttcagcacttggctgcagcctctaagacaagatcctctcctcctctggggagggataccactgatgtgcctttaaaaataaaaccaggcctgcttcctgccccaactgaaagactttgatctcccaatcatacgatttacaatatctcttaccacgcaatttctcaagccttcagcatatgacctgacagtgctccgggagggttaaggatgggtatgggtgggattgaggagttggccctttaacgcagcccttcctcacccaccccaaaaatgatttgttacaacaccaaagtggcactgtctgcagcaccccttctctgtaccccagaaccatctcaacccgtgccttgtccatgctggggtcctatgagaagcaattcttgctgtttcttttgtggaaccacaagcttcaagtttcttccctatttcaggcttttaaaaacatgtcatcatgaacttacatgcaaaacataaaactacagatcttttaagagaaaacacaagagaaaatctttgggatctacaggtaaaattcttagacctgacgctaaaagcacaatccataaaaggaaaacttaacacttattaggctttatcacaattaaaaatgtttgttcagtgaaagactctgctaagatgaaaagacaagctacagattgagagaaagtatttacaaatcacatatctaacaaagaactggtatccagaatatatatccagactatacaaacatctcacaaaactcaagagcaaaacaacaacaaaaaacaaccaaaaaatccaattagaaaatgggcaaaaggcatgaatggacattttaccaaaaagaatctacaggtggcaaacaagcaaatgaaaagatgcttaacatcattggtcatcatgcaaataaaaatgaaaaccataatgagctatcactgcacacctatcagaatggctgaaattaaaaaaatacaacaccacggtcaggcgcggtagctcacacctgtaatcccagtactttgggaggctgaggcgggtggatcatttgaggtcaggagttcaagaccagcctgaccaacatggcgaaaccctgtctctactaaaaatacaaaaattagccaggcctggtggcgtaagcctgcaatcccagcttctggggaggctgaggcataagaatcacttgaacccaggaggcagaggttgcagtgagcagaaatcatgccactgcactccagcctgagcaacagagcgagactctgtctcaaaaaaattaaaaaaaaaaaaaaaaaaacacaccaccaaatgctggccataatgtggagaaacggaattgcctatacactgccggtagaaatgtcaaatggtatggccattctggaagagtctgacggtttcttaaaaaaactaaacatgcaactcccatatgacctgtcaattgcactcctgggcatttatcccagagaagtgaaaatttatgttcacacacacaaaagaaacccaaacacaaatgttcatagcagtattttttaaaagcagccccaaactggaaacattctagatgtccttcatcgggtgaatggttaaagtacggcacatccatattatggaatacaactctgtgattaaaaaggaatggaacgacacatacaataacctagatgaacctccagggaattacgctgagtgaaaaaagccaatcccaaaaggttatccatactttattattccattatataaaactctaaatgaaaaaactacaaatttggagaacacattagaagtcaaccagggggggctaggcatggtgggtcaagcctgtaatcccagcactttgggaggccgaggcaggcagatcacttgaggtcaggagtttgagaccagccttcccaacagggtgaaaccccatctctactaaaaacaaaaaacaaaaaacaaaaatacaagaattagccaggtgtggtggtgcatacctgtaatcccaggtatttgggaggctgaggcagaagaatcacgtaaacctggaagactgaggttgcagtgagccaaggtcacaccactgcactctagcctggatggcagagcaagactctgtctcaaaaagaaaacaaaagacaaccaagggtgtgagggcaagaagtaaatgactgtggccataaaggggagagatccttgcaatgatacaaatattctgcattctgactgcatcgatgtcaatatcctggttatgaaaagctgtacaagatgtcaccattgggagaaactgggtttaagggtacgtgagggatctccccatattactttttttttttttacaactgcatgtgaatcaacaattatccctaagtatcattaaaacaacaatacaaaagtgtcatggcattcacggtggaatcagatggaaagtctgggggagttcccagtggaatcagccttcctgctactttactagtctccagccatccttcaaaccagcagaaacttacacagtatgactgaggtctcagagccaagcaccaactaccactgggctctgtgtgatttctgaaatgtagggatatgcatgaactgtttaattacttcccatcatttaggaaagggctgagggctgggactcctagagacaagggtgttgctgataaagctgaggacagctagcgtggcccttgcctggcatcaggggttgtcatccagccctgtgtcttcttccagcactacttggccaaggaagacgtgccagacgtgcatgcccagaaagtggcagacgcaggttgccagacaccacactcccaaagcatcatccttcgtatactggccttgggaggtgttccatggaaagggtgctgggtgcaggcaagctcaggaaggggcatttcctcccccgcctcttgcagactccctcagcaggtcagcaaagaaaagcggcttaggagagatgataacaacacctttcactcggcttgctttggcatttgctaaacttacatgaccacaaaatccttttcatgaaacgaccattaacatcccacagaacaagtattccaggtggctcactactcactatctgtgggaaacaccacgtctctccccctcatttgaggtcaaaagacatacaacgcagagcccgggggtctggtgccagcctccaaatgaagccaaactgtgacaagcctgcacaggaagaactgaagaggaggggggaatatatgcctgtggtagcgaagtctaaacttcatggatgtgcatttagagacagggaagcagcactctctactgccaggggaacgtgaggagtggattttatcattctctaggtcagcacctctcatgctcccaaaatctcccttcctacctctgaaagaaaatgaaaacataatagagctatgatgaaatgatcttaggaagatctctgcttgtccttggagactcaaagggaacatcaagcactaaaggctctgaaatgttctgcaggaaagaaaggtgctcaccttcaactctgggttttctgaactttctgaacacagagcactcttttccccctcaatgccatctactggcacctctagaatccaggcactccttaatgtcatcttttacgcagcctgctgcacctccctcattttccttccgtctctgcagtggggaacgggtggcatctcccagcatgggctggacgcctgcagggatctgcagtgactctccaccttcgcttcacagaaagcctttcccaaaccacctgctggcccctcaaacaagcgagcagagactgggagagcccttttttgacacatctgtggtaaggtaagagcaatttctcatctaagcaaacagaggcttgaaaagctgctgctagaacatggcagaaccaggactcaaaccccaataatgagccctgggggcaagccctgtccacctctgggccaggcggcctctcacatggcagtttccactaatactttttctcccttgacaccctgcctgcctcttcagtaaatccaggcaagcaagacttatcccctggctggagagccacgccctccagcacccctcagcaggccacttctactataacgtgcccaagcctgtctctccaccttgaataagtatctaaaacaacctagtgtctgccccataccccacaatcacttatccttaagatgacccttccacttggtccctcagagtcattcatccatacatggatgggatgcctgctacatgcagctgctgcaaggaaagacggacgtggctactgtgccatcagcccctcaccccagccccagaggagacagagggatgtcataggtgcagtggcagaggggaacacaacatcatggggggaggaggtcagaagaggggcggctattccagatcaaggtagcaaaatgaagcaggtacaggatccagagacacacccagtgtgggctttccttacgcacaatttagaggtgggagaacaggaagaaatggagccagggccaactctgaaagagctgggactttgtcccatagaggatgggaagccacgaagggacccttcattcatgtcttcgtcaaatattgatgaaggtacttcattgggtggctggtgtggagtggggagggatgagggctgcctcagagccacatctggatgcttgggagccaaggccttggggaacccctgtagagatgagatgcagggcccagatttggcaccggacccgaagggcctgctagggtgctaccccctgtcccactccacgcagactctgcaacatagagcacacagctcagccggccttctccacagaattcataaacatgtgagcctgccaggaacctggggccccagaactacagggtcacccacaacagcagttctcaactagggatgtgagtctgttccaaagaacatacagcccaggcctccagtagggaagcagccatgtgtgtttttaaccctggttgagtatggttgatactgaaccagcccctctccttacaggtgagggaacagaagtcacaaagagaagtgttttgtgaaacgtcctataatggatccataatgtcagagtagggaccacaagccaagtgccctgacactcgttcctctgaacactactggtgctaacaagggggaaaaggccctgtacactccaggaagggatgtttcctcccagttcccaagagttggaatgagccttgggttacgtcccgacaagaggacggtgagagggcttcccctgcagcagagataccactgcagaaattccagcacccaactggaggtgagcaaaaatggaccaatgccctctactgaaatgcccacaaagggatggcgctgtgagaggccacctggtcctcaccactatgccaacaactcacgccttttggctttctcttcctagaggtgacccatgaggccaccaaggcagggaatgcacatctctgccatatcaccatttcctttgatgacgtattgaatctctcagggactacagctcttttccagggaatgggggaaagtgaagacaggcactgggctcttacttggaaccaaatagttgctatagcatcaccaaatcagggttctcgttaacacacactagaggagaggaagacagagcaggggccagcctagcccgtgaggaaagccaggtggtgaaagggtttatcacagctgtctgcaaggccatggggaaggggagcccctggaagaactgcgccaaggcctccccgggcccagcccacgaagcccatgctggctttctcaacacgccagctctcattccgattgagaagaacccaacaattacgaggcagaaaaacttcactatgcatgctgataaccactgtttttccccttataaaaagtacatttgatttgcagaaaagtcacattctaaaaagtccaaggggaattttttttctcatttccaaagttctactctttgcaacttaacctagcatccaattccaaacacaaccttcacaaaatcccattatacaattatccaactcaattttagcaccagaactttgctatattacaataaagcttttgggtgagatccttcagtttctatatcatctatttacttttttttttttttaaaaagagccaagtcttacttttgaagttataaagaaaaaggtgtttaaggagcttagaataagtcagttttgcctattgttttactataaagagagttttttccaccatcatggtgggacatttctgacatataggtagaatgcaaatgacagttgggtgggctatcagaagaaagaatgacccagataaggggcaaatccacagttgaattctgtgatctccaaataaggtgggcaggtctaatcagaccaaacaccctcacccgcgcaccaccaaagcaacttcctcatcacgctgtggctaactgcacagtatcttcaaattaaatcaacagtgaaaagaggtaaactaaaacctctactagggatccccagagtcctaagtactaaaatgaaggccagcctcaatatttatttcccctccacctggtgagaaagaaagagggggaaaaaaaggagtggagggaggtgggggagcctgggtattttaaatgatagttatgagaggggaggagacaagaggaggaacaatgcctttcagttgcaattatccagctgtggcttattaaagcttttggctgcacactgaaatgacctggagagcttttttaaaaaaccaccacaacgcctgggcccaacactcaccccctctgctccccagcccactaactcgaggttttgatttaactgccctgagacgtagacatctagatttttttaagctccctaggtcattctactatgagtgagagccaccgcttaaacatttgcctagcactttgctgcttgctgcacctaccccaggtagagaaacagaagatgacaagagaggagagaaaataaactctgctgctgtcctcaacagctcccgtaagaggaatgaacagatacatatacgagggttttctgtaagcttcaactggtttataggagggtgagccatgatggatatctgcaagtaagatccatttttatgggatgtaaatagacccctctccagtctccaataccaggcggcctccagggttcagtgtagacagcagcaatgcccctcagagcacagcagcaaaagcaggcttgccttgcccacaaccccaaaggtgctcagtacaaagctgtcagagatagcaagagtgtctaacactcagtgcacgttcagtatataccagacactatactgaggacacatactgtttagttaatcctaaccaccaccttatcagcaaatatcattttatgagtgagaaaactgaggcctgagagaacctgcccaggtgacatagcaaaggtgatgcaggcaggactcaaacccagatctgatggatacagagccttctcttaaccactgtgcaaaaatgccccctctctataaagcccacatgatgcctgaatcagcgtaaggtgaagagatccatttgtacctacctttgtcctaccgctacgtggaaaaggagccctgctatttacaaactaacgtcacagcagctgtccccgaggaaaaaaagtatcagagcccccaaagagactctacaataggacagctagttgggcagaagccagtggcccctgagagggcagcccatgagtacctctggggctgcacacttcacagcacacatttcacctcctggttgatgaagttgggaagaaaaaaaaccacaaactggcacctttatttcagctgtttgggtttgaaaggcatccaggaagtgaggaaactgcagaggaatttgccttgaagtgatgtcttcgggggcagatagccactatccgagaatctactggcacaatcgaacacgtttgggctctgccgagacctgacgacaagagtgtttttcctcactgtacctttcacagatggccggcataatcagctctgaattgacatgagagagagagacagggaaagatagtagggggaaggaccttctgttacttcgcatcagtgaaagaaaatcataccaagagctacccaaagcaagttcacctcgggtcagaaagaggcttttaaagcaagggcattacagaggcacgcagcaccactttgggagatgcatgctgcatttgcagggtaggagcctctgactccacactccagagtatcatcgaagcctctgggccacaataccaaggcttcccacacctagtacagtttgaaatgtcagcacttaaaatgacaagacccttctaggcacccagaccacatacttccaagtgtacagtgagcataagccccagagatggagagaaataacaggatccaactttgatgcttccttgctctgtgacgttgagcacgttacttgccgtctctgtgctttaggtgcctcatctgtaaattgtgcttaacagatcctgtgtctcataggactgcagaggtgacacagtaagacaggtcccgggaagtccatagagcaacgcctgccaatatcagtgtaccatatatgctgacggtcactattttttcttctcaaaaggctgaacaatacaagattgctgatgtctgaccactactgaacaaaacacaaacagtgatttcatgggactcaatatactgagtcaactattctatctttaaaaactcttgcctttaaacaagcagggggaatccaatattccctatgtatggcccaacaatgacaggccttatgaaggaaaggcccggcataaacacaaacacatttcttccacttgggctataaaagctgaaaatggctcccaggtgtgagcagacacaataggccctgccttctctgcaaggtcaccacacaggtcaaagtcaagccagccattttcagattaggtgcatatgcacatgaggcttcccagtggtaactggattacagaagccacctgcaggaagtgaggagggggaggaggaggaggaggaggaggaggaaatggtcccagttggaatgagactgttgatatgggctggagccaacccctttcacacgggagattgtgcaatgacagagcagctccgcttcccggctccatttcaagcagccctggagggttttcagcactcactgctggaagaagcagcacttcccctccgagaccatccactgcttctccaacattggggagcaacccgggtccccagtggatcttgggctatatttaaagcttgcatggtcatcaggaaaagggaaagaaagagagaaagaggcgggcggggtggtggaaaggaaaaaagccctacgctcaacaaaagctaccgagtttccaaaagaggcagtgatctctgtgaccaagctcctattccatgggatctccccttcctcggctcccccaaccccacagctggtgttcccttcactttctcagcaaatgacttgcagatgtacctctcatctggctggctcaccacccccactctcaaagaaaggagaaaaaaggaaagaaaagagagaaggaaaatgacaagtcatgactgtgtaatttggcaggctggctgcggaggccacagcagctcttttcccagcgaaaggcttgcttagactgggggcaagtggcagtctgcactacggaatccctgggaagtttccgggacagagagctgctttctttgtaaattgggtgtttaattttctattttgaggctccttggtggtatccagcatctgatgaggctgcagttctaagaactgcaacagcggcctgctggctcttcataaaagcccgcctgttgaaaaagaaaaaaggcagggaagggagggtatgtgttgggggcaggggatgagtgaggggcgggggatgagtgagggggcgggggatgagtgagggggtgtgtgtgtgcacaaattggcctaaagatggaattagccatgtccttttggtattcctctgaatgctcctccaagtacccactgtgttggctgaacatttagggtgttacttacacctgtaacttacacctctgtgtaggggaagagaaaggaggtttgcagaacagggagcctcagctaaaatgtcacttcatctgggaaacttctctgtcatgtgacccatcagtgacgggcagtgaggtgccccttagacattccccagcccctgtatgacaactgtctgttcacccatcttcctctgcagctagactgccagttccttgagggcagtaactccaggcccataggacccgatctgtttgctcacgaaaggccttgagtggggcatgtgctggccaacttcacagcagccgtgcagaggaacccacggtctccaccatgaaccagctgagacttcctccacattttcatctcttttgcccactgttgacctgaccacagttcccaggctgggaaaatgggaggagagtaatctggtcataaacaatgcagtgctaggaaagggcaatggggcaggtggggaccccagtagggtgggggaaaaaatgcccacctttcagacacgcctgttaacttccatctggaaaaagaggtggcattcaagtcttagctgaggataaagactgatcagatacgagtgactgataatcaaaagaaaggtaagtgtgctaaaactgactcctgccgggggagaggggatgctcacctgtaagcagagctgccagcacccaccggctgagagagtaacagggctcctgccacgttgggctgctcacgaagcgctctccacctctacagcagccggtgaaggtctgctgggcagacttgagtggtcaccaacaaacagcaaattaagcacaagcaaatatgtaacagtcatgggcctccaaccctgagccacccaggtctgttctgtccgtggtactggagctcactctgcccactgccccagagcctttctcagaagccattaccagggccatagagccccactgtcccaaacaaatgcctgccaccacactggtgacattaggagtggaaatttactgtcccccaaggcctaaacagcttggtcagaaccgacacatgagccttggggctccccccagccccatatgagccccaggagtggttctcaaagccacctggccagcagcagtggcatcatcacctgggaactcatgagcaaagcaaattctcttgtcccatcccagacccgttgaaccaagccagaaacgagggtaagacccagtgacttgtgtctcagcaagccctacaggtggtctaccagtgagcagaggctggcatctcccaagggaaagggcatgaggttttatccagaagaaacaatcagttcacatcaacaaaaatctgtgcaaacagggaaggaagtgaacacatctttgaaaactcagaagaggaccagaactttagataattatatatatatatatatacacacacacatatctgtatctatctatatacatatatatacatatatacacatatatatacgtgtgtatatgtatgtgtatatatataattcctccctgttgtgctggttttttttgactaggcctgtatcttccccctttagcatctgggaaccaaaacagcttcggactacccaaggaacaaaaggcattcacttgaactcagcctgggccttttaaaacagctttgctcacattttcttcctaaagtagctggagtcattcactcttaactccacactcttaatgagaattcattttattgccagagcaataaaatgcctgtagcccaggtaaggtttacttttacactgacggtttacttttacccaaatggtaaaagtaaggttttttttttttaaagtaaggtttacttttacccaaacggactggccatccttcaatagtaaagctaaatcaggttgctacgcgggggaagcctgtccaaagtagcatggggacctatatacttgttttcatattttctaacacccttgattaggtccactcttaatctggtgactggtggagggaccagcagataattcctccgaaggaaggatggggcaacccttggtcttggggagaatctctacgcccacctcgactgtacacacacctatggtgcccacaggtccagctaggaataaatgcacaaagagctccaccatctgagattaccactcaacttttaaagacaaattcttatttcatccctccaaagataaacatcacatggaaaaatgtttcacatcaattctttattatgccagtgaaggatgcctttcttcaggagatgcaacatggagaaagttttaaaggcaggcagtgaagagaaggacaagacgtctcaacccagctccttagatggagaataagtctgcccatccccacacacacatgcagtgggaatgccagccgctgcctgttcctcagtataatctcacctgtgcttcaagcctgattattaacaaccttagctcagatcatgaggccgagcctaattttccgacgttgcactccaggtcacttccagcttgggccttctaagggactctcattattccccccagccctgagctgcagcagatcacagctgcctctctctaaggctcactctttaattacactttaatgcgaactgatctttgcattaacgagcctgtaaagaagattgatttcgcccctctttttttccagagggtttgctaggtactcagagagttaagtattcctattgactttacttcaccaacagatccagccaagaagagggctcaggcctttgctgcctcagatccctccaaccccacccagggcttcgtccactcttcactcacccccggggaagggggaaggtgaccacctccccgcttggtcacaggtaggacaccgcgtttctttccttccaagttttattctccagaaattacaacagagggctgttaagtatcctatcctctcccgcccacccgccttttttttttttttttttttgagaaagagtttgttcttctctcccaggctagagtgcaatggtgcgatcttagctcactgcaacctccgcctcccaggttcatgtgattctcctgctgcagcctcctgagtagctgggattacctgcacctcccaccactcctggctgatttttgtatttttagtagagatggagtttcgccattttggccaggctggtctcgaactcctgacctcaggtgatccacctgcctcagcctcccaaactgctgggattacaggtgtgagccaccatgcccggccttcctatccctttcatttaatcacttctcttcagctaagaggtcacagcaaaatatagttaaagccacctcagatattttattaagttatttataaatgaagtcttccaggttcatttgttaacatgagagaaaaatgctttcctcaaaaaaaaaaaaattagttttcaaataagtggttaccaggggctagggtgagggatatgagaagtgactgttgaaggagtatggggttttttggggggcggggtgggttggggggtgatgaaaatgttttagcattctgtagtggtgatggttgcacaacactgagaacgtactacaagtggcttttaaatggtgagttaatggtaagttcatttttttaaattttctgatttttttgtgagtacatagtaggtgtatatatttatggtgtacaagagctgttttgaaacaggcatgcagtgtataaaaatcacatcatggagaatggggcatccatgccctcaagcatttatcctttgtattacaaacaatccaattacactcttaattatttttaaatgtacaattaagttattattggctatagtcaccctgttatgctatcaaatagcaggtcttcattctatttttttgtacccattgaccagccccacactgcctccccatgtccctgggtacatttatcttatctcattaaaaaaaatagttttcaaaaacattttttcaagattagaagtaaaaggcatttcaatgtgttttcaaatgcaacctaaacctaaggaattttaatagcaatattacaaagtcacaattaattgtgtgcccctaagttttgcctaggtcttcctcctggttgaggacacaggctgtgggagagcaaatgacaaggcaccataaagggatgaagtctagaacaaaccagctggagaagttgttaggtagacaaggccaaccctatgggtaatatgctacagtccatgcacaggagacaaaagctaagaccaactataccacatacatttttactcccaggactgaaaaattcaacgatttccactgtcaccaatcttctcgacagtacaagtgcagcaacaccaccggaaaaacagagatttttcctcaacagaaatgtcattgatgcatcagacaaaattactgttgctgtgggaatcgtaacttgagtgtcctggattttaaattaaaaaagaaagaaatctcaaacgtgaaaatccactggcagcttctgcccccatttaacaaaagtctgtttctttttctcggcactattttatgaaattagctccctcaccggaacccattcttattaagagctttccttgagttctatgctttctgtttattaaggacaaatggctccggcattatcctcagaacacaatgcaaataaatctgttctttgacaaatatgttaactgaattagattcctttaatcagaaagtattaaccaactgaaattttgctctatgactccagttcccaaaactatggaagtctcttttgaagacctgacagaaaaagccaggtgcagagcaatgcctcttcccatgaggctctcccaatggtgccacccagcttgggagggctctggtgtctggaagtcggctcaattctgcataagcaaaatgaaacacagagagaaagggccaacttccagaggcaaaagtccataattataggtgtccaagctgaaaattaacaaacccactacttctgtgaaaagacagaaagcaacaacagtggttattggtcagagggtaactatgtcttttgtgacattattgcccctactctcaactttcgggtcacaaagagaatacacaagcttcgagggtacttctaccatctgcttcaacttcctcatctgagaaaaaaagtaacgtatgtatcccaggtcacaactacattagagacagcaggacccacacctagccctgacttttctgtgatgcatctacctataaacttgtcccaagaaagttgtctgggctcctgtcactcacatggcctcagcagacatttgctctattctctctgcatattttgattatttttttctgatcctctgtctgcccacaaaaacggaataagaatttgaggattaaggactataagcatctaactattaactaccacattttcagacgatgtgttgaggcttctgcttctccctgggacagcctctgggccacaactgcagggacacaaaaagtgcctactaaatatttacagaacacgtgacacccttcagttcactagttccgaaaagtaagagacacatcagcaaaacctgctgttcaaaacctggatgactggaatcatcatgtggatggggctgctaagtcttctgccttcattgattaggatgaggaaggtggttctttgggctgtaaaatgatgctcatccactgcctgctctgttgttttctcccttgtcctttgcacggtccacttgggaaatacagaaaaggcatgaagcattatcaataatccagctgcccagatgtcatgctgctaacctaacttgccagcactgaatccaggcatccaatctaagaatggggaacacaggcacctcagagaaaaccaagataaagccccttcggtttctgtcatttcagagaaatcactgaccaagtcagatggtgcccaacttcaggccaaagagctggctgccagtgctaacctgcattttccaaactgaatccaaacagggagtaactctcttttttttctctcctgctttacatacttcaatgctgtctaatggaatagcaggaacaaggccaaacagccccacttctcttggcacttgggccaaggaacagaaatgtatttttagtcagcagagcaaggtgcaattctaagtgccacaggcccgtggggcaaactgggggccctgcctgcctctggcacagtgtggttcagagtcacctgccacgctcctgccccgagtgcatggggttaaaggagtgatgcaaaggcgtttgtgtctggtctcagttccacctctcacttttacaacttataagacctccagggaggctcagtttcctctctgacaacacagagatattctctgtggccctagcttcctcactatgtgaggaacaagagcagttacatcagcatttctcaaacttgaactcgtggacaaacggccagggcccttgttaaatggagcttctgatccagtagtgttggcattaagcctgaggttctgcatttctaacaagctcgaagctaactcaatactgatggtccatgacctgtgctttaagcagcaaggagctcctagcatcttcaagtgctttgctttatggacacacaacaggttatcacatccctatcagcctcacataagacgaactcattgattaagccaaaaattaaacaccttccagatgctgggcccacaaaccaagtgggtacaaaataaagtcagacctttacccatcaagggaacaaagggccacaaaccttccttccagcacttcacagaaacagagactgactcttaaatcctgcggccttaaaggtgagatcctgccaagatccaaggagctacgtgacaactagccaccagccaatgacagtaaccaccatttgtcaaacactcccacagaatgctgggagcttcatatacattccactcccccgggcctcactttcctcatgtataaaatgggtcaaaaatgcattatgtaaatgagggaaacgaggttcagagagactaggtcatctgtccagggcacagagtgaagtgcaattctaaccccccacgctctcctgcaatcccacaatgccatgaaaagggttaaacccaagaccatgtttcacagggacacagcacctcctgaacacagggcatgctgccagccaaagatccgagatctgtaagctatgccagcactcttattaatagcaccttcttgcaaagtttctctgctcagcctgccgagcctcagtattgagaaaagattcatataggtgagcaaactaattataaaaccagcaaaatcaaaataaaattaaactatgaaagcctggagtggaaacaggaaattcagtgtgaagagggaggtgctctgctggggaagctgccaataaaatctggcagagaaaactgttggactcatggctggtttatctggaaagtcttctgggtgagtttaaaacaagcaagctcctccacctgactgctgaagaaataggggtaggatcagtgctcagttctctagcaaaggtttgtaacagcacaaatgataatattcccaatgggtgccttcatgtctttttagctaaggcccttcatctgctttttcatttccagtgtgctgtctagaacaaatagatcgcatcttatctaacacttgaccatgacaacatagttttacgttgattccagaggcctgggggcactttctttttcttaaagccacaaaagtaaactgagtcacattacccaattcactggcacaaagattagcttgctgtcttataactgacacagcttcctttaactccagttttactcaaagttgcagcttaaccaaccacagaagcaagaaatctagttccatatacctctgcgcattaaaaaaaaaaaagacaaaagacctactttcttgcaaattaaagatgaggtaaaacttccagcgtttaattctgcaaatcccaaaacagcaagcaaagcgtttgtcatgatcatgagggccacatgaagaaaggtctttcttcaccagcgagcacatgaactcaagttatcctgccaccaggtatcagcaaggcaacaaacaccatggccccaccacacagcccagagtcccccaaacggcaccacttacagaaagagagagacgacatgtgatgaagcagcgcccagggatggtaccgctgtcaactcattattattgaggtacctgtaacaacaacaagaaattaatcatgtaaggcatttgaattagtctgaaatcatacacatacaacagaaataaacaaacgctgctaagtctgccacagtaaacctatattctaatgttggagaaaagagaaagaatttagcagtgagtttttaaagggaaagaagtcacatgagatcacaaaaactagccactgatcacacccatggctagaaacaaacactaaggggaagcatctcctgtctcccatcagcttcccatcaaactcagaaatcaagacaaggaacagtgagaacaagccaagaggcaggttcgggacaaaagcgcccctaagaccatcggtgagaacactccccgtgggccgaaatttgcccctgtcaaagggcaacatgtgtggaacaagagccagagactcacgccctggctcacatggagttctgaggggcttgggacacatggggccaattatttcagtgcctcatctgtgaaataacaagggaactggactcagagactctcttccatttgaggttccagctggactctgatgaagcctctggatgcatcccccaggaaaatgaacatatatacacacacttttgcgcatagacactttgaaaattctccacagacgagagttgctctccaagctcccttcctgctaaaatagtccaaatatgtatttccatagttaatatctcttaacggaaggggaaacccacgaaccaaagcacggctcgcctggtctgcccccagaggctgtgcaatctggcctccttacatggacatgtatttccaaatctgggaagagaatccaaaatcagacttgcaaagtgagcccaacaatccttaagaaaaccaaagcaaagtgttcaggctttctgccaggtgatgggctagaaagaaattgtacttgcgatgcaaagtcaaggggataaaactgggttcttattctcagttttttaagggaggtacgtctaacacagagcatcctgtttctgtttgaagacaaagcaactgaaatcacagctgtactcatacaagtatacagctagcatgtgcttgaagagaataatctggttgtctgccatcttttatagaagtgaataggagaaggaaaaaaaaaaggaaaggccttgaattatcccatttgctttcttcagtgccaaagccagttagggatgaagcttggcaattactgggctgtgggacatagaatgcctgtttcaatagcttcatggctgaagcatctggcagagagaaggcagatccgtatcatgtggcaaatcttttctccacttaaagggcccttgtttgtgtgttgaaatagacaattaattactttaacagtctcttatctgactgccccctaaatcagattgtttctgcttcaccttttatctcctccaaccctgctgtgatccatttcccatcctcactcagggacactgaaaactccccattagtcttaatctcagctaataaatttttcatagtacccatcaacgtacctattattacaagagacccccaggttttatcagagcaagaaaaactaaggtcggggacctgctgtcaatcaggcagcttgcctaagaactctttcattgcttgcgatttcttctcaaacacagagaatgttagtaacaaaaacaaaagcaggtaaattaatgaaggctgactatgtgccaggcacagctctaagagcttttcagtatattaatgcatctctacagccctcagaagtaggtctcaggaacatttccactgcaccaatgaggaaactgaaacacagatgttaagtaatttgaccaaggtcaccagcaataagttgcagtggcccagggtgcctagccccaaagtctaggtttttcctcattaccttctatttctttatttcagcaaaaactcgacatgcctcgtgcactttcaccatcacaacaactttgaatcaggtaccaggttaactactaccattctctacattaccggtaagttctctaggccagtttaagtcactcatctagggtcatgctactagagaggacatggccaagacctgaaaaaagtatgactacaaaccagaggagagcagcgggctcaaaggccagctggaaagctcataatcccttaggtaacagcacagttgtttttcagccagcttaggatctcacttgattttaaacctgaaacaaagcgtatggacttctctgcagggggctacgcctgatgagcctggtctcaggccaggcctactgtatctgtgacaaactgctccacccaatttcacagaaataaatgaacaagggaagcgggcatcatgatatttcaaattgtgacagaactgctggaagtggagcatagaggggtggtggaccagtgctggagcttaactgggccttctatgtctagatgagcaggcccgagtcaagggctcagtcagaaacagtgggctctggtggcaacagggctgcctgacttacagggaggacactcaaagcccccaggagaggccctgcacagtgagcttacttccagatcatttctactgaaaaaagaaccgctattcagagtaagtctgttagctccaccactgctggctccctttttgttcactctgtcccctgttgaaacaagaatactctcctcagaaggcagcagaggcccagctcactctgagatgcaaagaacttcttgccagactgaaatagagactggtcaaaaatagcacagctacagctttgaggggaaaggcactcaggaagtttagcagagtctccatgaataaagaaattttaggaagtaaagattgtgcctgatgaaatttttttaaatatctacgattgtacagtcttctctcaccccctacccgccaatttacttcccctgccgacgcccatctctccccacaatttacttccatccaaggccctaaaaatctctctgaaacgtctggtctctatttctaaaccttttctgatgattcaggattaagaagtgcctcagatgcatcagacccatgaatcacggccagaccctggggctagagaaggtgtagctaaggtaaaaggattccggaccccagggcagaacctaggggtgggtcctttcccaattcaatccgtaaggtcagcttggaccttctggtccctcacctttctcccaaaacttccatttaattgacttaagggaagttttacattttgtaagctacaaaatgtgataaaggctatttcatagtactacatcatcatcatcatcaatcttaatcaaatttggcttcaacaatgtcaaaccaatgcagaaattgtgcttgtcttttttctgagacggagtctcgctctgtggtggcccaggctggagtacattggcatgatctcggctcactgtaacctctgcctcctgggttcaagcgattctcctgcctcagcctcccgagtagctgggattataggcacaggccaccacactcagctaatttttttatttttagtagacacggggtttcgtcatgttggccaggctggtctcgaactcctgacctcaggtgatccgcccttctcggcctctcaatgtgctgagattacaggcgtgagccaccatgcctgaatttttcttgctgttatttatttactcattaaatagctggtataagcacagagtaaagttttcaaaccatttcaaaaaagaatacatagtaaacataaagcttctttgcagttccatcctctggtctgcctccaaagggcagctcctgctgctggctactagagatgtgtatgtgtttttcttttgcacaaatgtacgtgtattaaacagactgttgtgtaccgccatttctctttagtaatatatcttggaggtctccactattcgtttaactggtggcacagtagtcctctgctggtatgaatggaccataatttatctggccaatccactactggcagacatagtggctgtttctttggttgctcccaaatacagacagagctgcaattaatagtagtcaaagttgggcagtgcgttgaaactgtagttggttttgtttcttaaaagggtgaaagccatcagtatcacataggaatatgggtttcggaagcagggccacttaataactgtattctgctttagttactagagaataatgtatactaactaattgatgtggtgagactttatgatacgtggtttctacacaagatagccagataaaattattttagcgtaggatataattactttaacaaaataaacaataataaaggtgaacatctactatgtgccagactctgtcctaagttttctatgtgcaatatctcagtgaatgacatgctaacactttgaggaaagtactaaattatcacctctccttaagaaaggaaactgaggcacagttacagaacagggattattaggatgggattatatagctcagatgtttaaatcagacatatcttggttcactcaactccaattgcaccctttatcaatccaatgctaagcatgtcactcagccttgctgtcccttacttccctcttctgaagaatgtaaataatacaagtgccagctttgtagggttttgggaggatccagctgaaataattaaacctaagatctcaggatattgacagatacacaggatatgcttaagagatggcaggaggaccaggcatggtggctcacacctgtattccagccctttgggaggccaaggcaggaggatcatttaagcccagtagttcgagactagcctgggcaacatgacaaaacccatctctacaaaaaattagccaggagtggttgtgcacgcctgtagttccagctactcaggaggctgaggtgcgaggatcgcttgagcctgggaatttgaggctgcagtcagctatgaccataccactgcactctagcctgggcaacagagtgagatcctgtcttaaaaaaaaaaaaaaaaaaaagtgatagtaattcacagccaaaaggcagtaccccaaaacgacaaccctcattattttaccctctccctaaacatactaccatcccccgcacccctgctcacacacacccactgtggggagcagcagcctgacacagtgcgatgaaccacaaatacccaatagcaggcagggcacacttgaggcttccttaccaggtcagtggccctggcaagcacacggcaacacccacagcaggcactcgcgggccaggcggcagtactgtgatctgaaggcagtatctacagaggactgtataaatagccccttttattaatagaggagcctgctggccaggaccccagctggaggcactccctggtgggctttcctcagggctgtgggcagtgaagaccgtgtggcttggacgcagctgcacaagcgtcctcatgtcctccaggggcctcgccttctctctccagccggcccatgatgtcatgtggttctgaggcctccagaataaaaccactgctaaaccactgcctgctgttctgccagcctgtggctccattctcaatgagggctccagactgaaggctctataaagtttgggagagctgacagcgcctgggcaacactggagactggttaattttgaagcagtagcatgtcagctacgattttttttcttttcttcaatatccttccccacctccccacccctcaacacctaacagcctctttctgtctccacgactttttagaattcccttagggtaaggcctgggtcttttatcagtgagaagttctactgttctaggcagcagggaattcatctcatccatctcacagaacagggagtgacactagggataggaggcacaatggtaagacattcaaccagtcagcctgcaaagattcatttctaaacaatgcacccagcttggagggctgggcagttccaaacgtagcaggagagaagagggataatattcagtgagcctctcgcatgtgcaaggccctgtgcatcatcttaataactacagtaacaccaacaatgtgttacgatgtcaatgttacagaagaaagaaagcaaacgctgaggcactaagtaacttgtctagggtctcaggaccctagtaaggggcagaaccagaaatcaaacgtgagtctatttgctaccaaaatgagagtttttcccaccacatcatattgaatccctaagatatgacctctgtcttaacatcccccacactcagacggtactgttgccatagatggtgtggaccaggattatactggagaacatgggtcaagttctaccactcactaatcacgcaatttcagccaaatcccatgcctcagttcctcttcatcttcagttgactgtgagagttaagatgaaggatataggaatttaaggtagtgcagccgccaaggttagcacaggttttgagttcaactctcagctttaccaaccatgtgacactgtgcaagtttaacttttctaagtatctgtttcctcttctgcaaagcagagaaactccttttatttttattactttttttcagagatggggtcttgctctgttgggtggagtgcatggtgcaaacatggcacgctgaagcctcaacctcctgggctcaagcgatcttgaggcctcagcctcccaagaacctgggactacaggcatgggccactatgtccagctaattttttgtagagacagggtctcactttgttgctcacgctggtctcaaattcctgggctcaagtgatccttctgcacccagctgagaaaatgcttacaaagaaaatgttttaaggggctgggtggaaaatgttttaaggggctgggtgtgggggctcatacctgtaatcccagcacactgggaggccaaggcaggcagatcacatgaggccagacttcgagaccagcctggccaacacggcgaaatcccatctctactaaaaatacaaaaattagctgggcgtggtggtgcacatctgtaatcccagctacctgggaaactgaggcatgagaatcacttgaacccaggaggtggaggctgcaatgagctgaggtcacgccactgcactccagccacggtgacagagcaacactccatctcaaaaaaaagaaagaaagaaaatgttttatatcaggccaggcgtggtggctcatgcctctaatcctagcattttgggaggccaaggcgggtggatcacctaatgtcaggagttcaagatcagcctggccaacatggtgaaatctcatctctatctaaaatataaaaattagctgggcacggttgcaggcacctgtaatcccagctacctgggaggctaaggcaggggaatcacttgaaccgaagaggcggaggttgcagtgacccaagattgcactgcactccagcctgggagataagagcgaaactccatctcaaaaaaaaaaaaaaaagataatgttttatatcacagagttgatgttagggttaagtgatgtcgtattctccaaaggtttattagcacactgctacaattactgtgactgttcctaagtgagaaatatatttttgagactcataaccagtatctccaatgaaggaaaggtgggagtgctcagttctagagctgggtgggacataaactctaacaagtgctgagtacaggctgcaggtcacgggagccaaatcaaatgaaaggtaaaagcctgtctaggcaaggaacaacaggaacagggagttagaacaccactgaaaatgctcaccagagcatgtaccatgcctgcccctgatagataggggtcagtgagggttgaaaccataaaaggacctggcctctggccacgcacccctccatcgtgcatgccaggcacagtggtcctcagcctgttcccttcttgaggctctgtacttgcagtgctccctgtcctcatcattcacacctgctcactcaggaccttcctgatcacactgtttccgttatcaagcctccaaaattcttcatacaaaaaatactcccacattactctgttctatttcccccataccacttatctccaataagtcttactggtttccttattcagtccatggcttccctcaacttaatgtaaactcagtgagaggagaggtttgtctgcagggctggaattgggtagggaggggcacaaaatttaagggacagccaaaaacccagtcacgaggacaaagactatattaatgcaatattttttaaatatgaagatgaatgcaaaacaaaattcatgatgaacaaaatatgaaaagtttaaatcaagacaaaatcagcaacagcaccgtgtgaagccatcctggaactgaaggcaaaaggaaagaaatcagtaatactaatcctatcttgatctaagctttttatattttactcatcattttttttttacattcattttgactttcaaaatattgtatcaaaataccctttatcttgactgctgagtctttggtgtccccataaattttgcgcctgtgttgggtgcctcacttgcccctccccagtcccagccctatctgtgtcctgttcactcttgtagccccagcacccagaatagctcctggacagaggagatgctcgagtaagtattcaatgaaagcttgaatgatgctagagggaattctccaattttgtccagtcctaaaagaaaccactaagtttggagatgtacacagaatttgaatatattctaaccacaagcattaaagacagcttggatcagggaaagcactgggttacaaacctaacaagctccatgatggcctgggtttatcatcttggtgactatgatgggctgaactgtgttcccctagggtccatatgctgaagctctaacccctagtacctcagcatgtgactgcatttggagatggggcctttgaagaggtgatgggccctgatccaatatgactggtgtctttataagaagaggaaatctggacacacacagagacaccatgaatgcacacagaggagagaccacgtgagggcacagtgcaaggcctcggaagaaaccaaacctgccagtaccttgatcttggacttcctgcttccagactgtgagaagatgaatttctgctgttcaaggcacccagcctgtgctatttgtttgttatggcagcagccttagcaaactaacacagtgacccacttcaaacttcctttcccctgccatggactcactgatcctctgggagaatgagagtcctagagaaaccatttccaaggccccttcctgttctgatgcttctttaactgtggaagcctaaaccttttttaaacagaagcagaaattataaacgccaatctggagaatctggagatgagggtttggaatgcaagtattttgcaaattgtaccagctgatgaaattaaaatttctttagatatgtcatcaataatggaatcaaagaataacaagtaagcctgggtgcaatggctcacacctataaccccagcactttgggaggccaaagcaggaggatcacttgaggtcaggagttcaagaccagcctgaccaacatggcggaacaccatctctactaaaaaaattagctggatgtggtggcacacacctgtagtcccagctactcacaaggctggggtgtgaaaatcacttgaacccgggaggcagaggttacagtgagctgagatcacgccactgcactctagcctgggcaacagagcgagaccctgtcttaaacaaacaaacaaacaaacaaaaaacaacaaataagacttttatcagttactcataacaaaaatgggtaaaaaacttacctaataatgtctaataaaaataataatgaagtactgggtaggtaatatatgaaatatccacgtatagtagttttacataaaagctaaaacaggacattcaaaaacttttaatttacatgataaagtatcttatgtaaggataagtaggaaagactgatataaaaccacaatgtacagtttgatcctaaaattacatatgtacatgtaatagttttcactaggtgttcacaatgggtatgcctgggtgagaatactggtgattttcattcttcacacgtttctgtagttgccaatttttctacaatatgtatactacatatatgtgaaggtttctataaagtctccatgaaactaaaattcctgataatcctaacatccacatcaaaaacagaatgcattaaaaagaaggaaagactgcagcctgatttccaagacactgcaagggacagcaagcctagagctccaaaggcagtcatacctagctctgtttggaggtggagaggaacaggtaagcctctatagtccatccttctataacttcacttcctgggaaatacacgtttggtggctcacatgccactgttgagtgggctgattaacctgtaatcccagcacattgggaggccaaggcgcgcagatcacatgaggccagagttcgagaccagcctggccaacacggcaaaatctcatctctactaaaaatacaaaaattagctgggcgtggtggtgcaggaactgtgagaaagtaccagcccaggatgtgtcactccagttacaaggcttcccacaatggagggactctgctatacacccaccatgcgcccaggatttccaggagctctatgcctactgaattgtaacacacccttcaagagcctacagtaagggagagataagcaggagtagaattcatcaacacagtccatacacaaatgttccttcctacaagtttacactgcggatctaggggagtgagcgatgctgcaatacaagaggattttcccaaagagctctccatccttccatccaccagaggtttagggggagactcacacttcctgtaggttcggcaagtcctcaaaaccagcagggtcaatctcagagagtttgttgtaactcaggtttctggtaaagacagagagagaaaaaaacggaatcaacaacctggcatcatacccagaattcagaaatcttctcttctcctggctcccccaccctcaaatccaagcccccatcccatgatcatgtattaagtaaccgtattgatactgagatttacagacataccccctccccacctacatccataaataaggcactccaagcaactctatgaaaacccaaacgaatttctatcagtatcatttcactatttaacaacttggaaagaaattctaaggtaaaccagctccctacctacattaaggtgtcctggtccaaatgctttgcaccctatcaagtacaaggctattcttaacggcatttttttaaattaatgttttagtagcatcaacatcaagcagcagtaaaggagaaaagggaaaaaaccccttcattgtctaaaccagtggctctcaaccagggatgattttgccccccagaggacacttggcaatgtctggagacatttttggttgtcacaactggtggcagggagtggggggtgttactggcatctggtggatacaagccaaagatgctgttaaatatcttacaatgcacaggcagccctgcacgactgagaactgcgcggccctaaatgtcaatcctaggattcagaggttgaaaaaccctggtctacacaagagcttaagactaaaaattgcacaaatagtcaaagttcaagtgagtgtttagaaagtaaacactgtaagatcctgaatcataaggctacttatgaacacagtattcccacctacactgaataaaccgggagggacagtcacacaggagaaaagggccagttgctggaaattcttgttcgtgttaaccacaggcagggaaagcctcacatgagcagctttctcaagatgatggcgtctgtgtcaatggttcagaattaaaactctccctgcttcataacccagccatacccttagaggcggacaaagagcaagctgggcaactattctgttaggggaccacaatctcaaccagagcagcttcatctttcaggaacagaagccacaaagatgtgatccaaatgggccctaactttctttgccagaaagtaatctttccttgcctccaaagtctacccagccccgtgtttgccaaagaggttaacatttttcatctcagctattaattccactcacactactgccaattaacagtacgactaattttgagtttaaagtctgtctcagaaagtgtcacgtattgtggcaacaatcttttaaacttactccagagacatttcaatcaatactaacctagagctgagagccatttcactgtgagctcagagacgttcatctaaataaaagtcaaactacacttgaaactaatggcacttctgtattcatgggtacagcctgaattaaaagcaatttgtccagagattatgttaccataaagactgaaggtggtaatgctttaaaccgcatattgaactcaagtgtgagcttgtctgtgcctgggggtatttgttaatgggtacccagaaatcccaacttagacttgagaaagaaaatctagaaattgagagaattctcccacattagaaaaaggacttaatagactgagattttcttctattttgagcagattatcataaaaagggggatggaaatattgtttctgggtgtaaagatactgggagtttacgatgactgtaacttttgtatcatcataggtaacaggagttgtgaagcaggaagggatattagagaaatactcagaaaccacaaaggcaagagcttagaggacaagcaagtaagagagggctggtgagcctgccctgtgtgtaacaaggctgacacggaagtgcctgccgcacacctaaaggggcatttgcttcttgtcccccgaaacaagggccagtgcagacccgtcttctcagaggctcacgatctgaattcatgttttgtttggcccattcagggttgctttattacttaaaaaaaaaaaaaaaactgaaaagatttcacatatctgcaggccccatttggcttgaggatcgccagtttttgcctctgatctgggccactgactcttgaggccattaggttcaaagggaacatatgtttctggcttacacatgtggcctggatagagctagggctcaccaggtcttacgcaattaaactgatggctcggtttgggactatctgaaatgagataacttccctcacttcccacccagcaagtatccaaagtcttcagcaacttggtataaaaccatttaagtcacaacacccttgggtttgtctttcccttaaagagcagacaaaatgtattcacatttcaaaaatgttataaaaattttgctttttaggtaaggctacttgagcaaagggtcttccattccagtactatctagaagcctagcagtatcaggacttaacactgagatgccaacaagcagcaacagagatgaacacacttagaagtggaaacgttaagttttcacggggtcagctggaattaactagaaaagccacctatcaacattcaagtgttagggtgctacccagaaagggtaactctcctctcagagcacctgttggcaaaaaagaagacagccaccaaggctcacgtccctttctgctgtggacaaggggctgttctggtttttaagtctgagaagcaagtgggcctaaagagtggagccagctgtagatcctcaataggtttattgggaaataaggaaaatagttaccacattctccccaggaactacaatatgaaataaaatcctcagagacactttcttgttggcccaattcaagaagacaaactctgagcataatttttttttttttttttttttttttgagacgagtcttgctctgtcgcccaggctggagtgtagtggcatgatcttggcccactgtgacctccacctcttgttttcaagcaattctcctacctcagcctccagagtagctgggattacaggtgcctgccaccatgcccggctaatttttttgtatttttagtagagacagggtttcaccatgttggccaggctggtttcaaactcctgacctcaggtgatccacctgcctcagcctcccaaagtgctaggattacaggtgtgagccaccgtgcccggcctgagcataatttttttaatgtggtaaaatacatataacataaaatttgcctttgtaaccatttttaagtgtactcttcagtggcaccgagtaccttcacactgttgtgcaaccatcaccaccgtccatctccagaactttagaagtttctcaacatcccaaactgaaagtctgtactcactgaacactagctcctcattcccctctgtcctagcccctggcaaccaccattctacttctgtctctaagaatctgactactcttaagtacctcatgttggtagattatagaatatttgtccttttgtgagtggcttaattcacttaacataatgtcttcaagattcatccatgttgtcacatgtgtcagaatttcattttttttagagacagggtctcactctgtcacccaggctggaatgcagtggtgcagtcatggctcactgcagcctcaaactcttgggctcaagtgatcctcctgtttcagcctcccaagtagctgggagtacaggcacacacaccaccacacctggctaaattttacttttttagtagacatggtggggggagggtctccctatattgcccaggctagtcttgaactcctggcctgaagcaatcctcccacctcagcctcccaaagtgataggattaccggagtaagccactgcacctggcagaatttcatttctttttaaggctaactaatattcccatgtatgtatataccacattttgtgtatccattcatcacagatgacatttgggttgttcctccttttggctattgtgaatgatgttgctatcaacattgccattttttttccaaatttttaaaattacttagttttttcaagacttttcactgcttactgataacacgcatttctcagtaattaagaaaatacacttagcccaagagctctgcagcaagcagcgtgaattcccatctgagatcccaagaacaatcaaagagttaatcagtgaaaatctttaatgaggcctttctttcaggtggcagctgacatgcacacacatctaaagcatctcacttatttctatgaacacgatcgccctgtaccaggcctgacatctgaatgtgtcttcagttgaaggtttcaaattctcctgtcaaaacaattcatctgtcagtaggaaagatgctgtcaaaagcatttctgcacctttcagtagcaaagaggagaggaaagaaacctcggagaatttagttactgccaattgcagctttaattaaacattctgtcagccattgtcataacacaaattttccctgctcttgcacaaagggtgcgcagatctctgaacaactgagcccagcaatagatgttctttcagctaatctgctgaaagatgaccgttcagcccaccgttcgctgaacacacaagaggcacctctgcagaggacagctcaagttttatccaggcgtgtctgaaaagcaaactgtttaccagtgcacaacaacagtttgctcgctgagcacgtttcctaacaagtccccttgccccaaccccaaggaatccgaagagctaaagtccttcaatagctgcaaaatccccaccactatctaaatctgtgctgtccaatttagtagccactggctatttacatgtatatttaaatgaaattaaaattacataaaattaagaattcagttccttggccacactagctatttttttttttttttttttttgagatggagtctcgctctgtcgcccaggctggcgtgcagcggtgcatctccgctcactacaagctccgtctcctgggttcacaccattctcctgcctcagcctccccagtagctgggactacagtcacctgccaccacgcccagctaattttttgtattttttaagtagagacagggtttcaccgtgttagccaggatggtcttgatctcctgacctcgtgatgtgcccgcctcggcctcccaaagtgctgggattacaggcgtgagccaccacgcccagcccacattagctatatttcaagtgttcaacagtaccacgtggctagtggctatcaaaatgtacaatgcagacagaggttatttctatcagcactgaaatttctattaaactgtgctgtgtctgaattacaaaataaccaacgaatatatctatatcatgaaataatccacaaacatttcaagttaaatgtcacctacagaagcaacttgaatctaaaacacaaatctgagctacccaataactcgagaactatgtaaaaggctgtggtgagggatggacactgatattaacacaagtcctttgagcacacaaaaagttctgaaccatctcaacaagggaaagagccttcaaaaactgaagttatgaggaagacattcttaataaaaactgccctcagagtataattctataggcttaaacggtatttatctaatctgacaagcaccttcctggattacaaccagaaccacatattacaaacttggcaaatgttattcaaagctggtgaacagtaattcattgactccttggaagttgagggataaaaagttgtttacttttgagtaagctgtggtgaggaaacaaccccacttcgttagacaacagaattatcacttcatccccaaaagcaagcattgctcacagaccactgacgaacacagacaaaatctctcactgtgaagaggagcgcaacccatggctccatttttcaacattaacagaataattcaaagtggaaggaattggtcctaaatccgtgacaagcattccctgaagaatgaggttttcatacttggtttggtttccaggctagcctatttcccattactcaattctgtctggactcctgagcgccacagtattttgcatattttaagctttcagatgtttgctaaactgcattaatacagctggaaagtaagtgtgaggcaatccaacaacccaacttctgagcaccagtgggcacccagctctggcctgggagccgtgggctctggcgattcatctctttctcaacctcagaacgtgcactgtcagccactcgttaaaaaattgcctgcttgggactcaccagaaaaaggtggaaaaaggtgattcgtcctttcaaaatttcagcgggtgcaaataaggaagaacatgcaacaatgtttaagttatttaatcctttaagcttttaagactgtttctgctgcatttttactttctgaggaattacatagtacacatcaagctccaatgaaatcaccacattatgttcccatgttgtaaggttttataaaagagaataagacttcgttcaaatcccagaatattagatgttcttacctttttttgtattgtgatgcttccccttgttaaccaaaaaccacaactgaacaagcggataatgcacattaaaggcttatattaagatgacaaaattgtatcttgaactggaatcattcctctagtatcctatccaaggatctccactcaggagaaggttctgtacttgctgctacctctcttcagtaagctaagcagccacatattccctatggcaaaagaacatattctgcaaataatcaaatgaaaaaaatcactcagatctcaacatgatacaaatagctcattttgtaagcttttgggcagttgtatctcacaaagtcagtaatgagtcaccagttatttccatttctgaaaattttacatagaccattatctatgcaaataagggaaacctacagtgactcaaaataggagatactatatacatacagctatatatggacccagactcattgcctatttttactccttaaaaatcagctataataatcagtgtgggcctctgaagtctaacgcccgtgacgttaactgagagaagaaactcatgcctacctctgtgatcccataaggtcttacatgtgcttctcggccttactagttcacacatgtcatcctggtctgtagctaatttgagtacaagtctacatcttttccctctagcacccaacaaatgtcaaatttgacaaatatttattgtctacaaggtatactgcactgtgataaactgataacaaattaggataagatctagtctgtgacttgaagtggtttacaacccactggtcaagttaagactcctggccgggtgtggtggttcacgcctataaatctcagcactttcggaggctaaagtcggggaatcactttaggcctggaatttgagaccagcctgggcaacatagtgagaccctgtccctaccaaaaaaaaaaaaaaaaaaagaatactgaccaaataacacagccaaaggctctgacacttgcaagcattctgtaatggtagatcagtagctacaaattggtagtttgtgggtacaaagctgggctgcagggaaacttgcttgtttctgactgaacagtgttggtagaaacctaaagttttcaccaaaaactaaagtttcagcttttcttgaaaataatcggagggccagcattcctaacagaaacaatcaactacatgcatttaccaagcattccaatgaccacagacctcaccactccttattgtctcacccatgccctctttattcaccggcagtatcttcccagcccgagatctgagtttgtcatccctagcatggataacatgaatgaaggccagatggcgtccagagcaggaaagatcagctgtaatgagaaacgtttattgaaaatgcaagatttcagctaagcctagaagaagagcatgtttttttgaagaggagtcctgggaaacgaggccagaaaagtaaaataaggaatggagggcatggagtaaaataagcaaacaaaaaggccaagaagtcaggacctcctagaaaggaaagggcaagacacaaatggttttacagcaaagttgagaagaatagccccatgctgccagacccacaacccaccaggcggttaagtcaagggttatataaaccttagcaaaccccagtgccaggtccctcacgaacattaatctatggggccattaaagttgatttccataagaacagagtatcgccttgttcatttacttaaaagttctgaactagataatcaagaggcccaatttgttttctcaccatcactgaaggcagttagcatttgctttctatactaccccttaaaatgggagattctaggatctttcctaccaaaaatcttagtttggccaaaaagaaacaaaataattagctataatgggttttgttttgttttactttaagcagtctcatctttagtgcagtttagtactgaggaaagcccacaaatttcccataatagtctcttgttaatatggtatgtgcatcattaacccctaaagattaattaatttaattaagaagaggcgctccaacacaccagctctgcagttggtggggactttacaagcaaaaggaatttgggcagggaatagctgctgccagaggctgaccctcccacagacctgccacaaagggaatatcaccatggccaccccagcaggcaagaggtgcctacagccaccatttggctttgctattagagaagtgctttgcagaggcttggaaatggggagcgggaagagatgggtcagaagtctggtcattcaggatcgcctattctctactttatcatctccaaaaagaaacactaattcactaactttcacatagtccttaagctctacaggacttggcaaactcatcacctgcacaatagcccccctatcctcaccccatccagtaacagagctgaatctttacctcctgggagcccagtcattctgcagaacagaggggggttggaaccttggagccaggtgctccctgctcccactgaactcttccccgaggtgccctgacagcctagggccccagccgctgcagggagagcaaaggctcatccatcccaaccagcagggacggagggcatggcggggatgaagggcggccagaggtaaaacccagaggttctctcagttaaaggatggcagagggttctcataaatgaaaaccacgctctactgcggcagaaaacggagacttttgcttctggagtactgaaaacaagtcaggcaaaagggacaggaaatatgggatgggtaaaactgagaaaaaggacacattaacctggtggatacatttggaatcccaggttcaccaagtgctttgtaaagtccaccaaagcttctctggtcacggattactgttttcctttcctaaaacttccacctttacccctccacatccgcccctggcccctgctaaatgtccactttcaggagactgattagcttcctatgaaaccaccaatgcaaaatccagggtgtttctgaaaatgtgatgcagctttaaaattcactaacttcgggccaggcgtggtggctcatgcctgtaatcccagcactttgggaggccaaggcaggcagaccatgaggtcaggagatcaagaccatcctggctaacacgatgaaatcccatctctactaaaaatacaaaaaattagcctggcgtggtggtgggcgcctgtagtcccagctgctggggaggctgaggcaggagaatggcgagaacccgggaggcggagcgtgcagtgagccgagatcacactactgcactccagcctgggtgacagagcaagactctgtctcaaaaaaaaaaaaaaaaaaaaaaaaaaaaaacactaacttcggatggtcacaggaaagatgcaaactaacaaggaaagcttcttcgactgccatgtgccacacaacagaattgcgtaaactttggcacagtcaccacccgtaagtgatgctgtgatgaatctcctgttccgatacactgaaatgattcaccacttaacggtgagtgattttacacactacacgctcacacctaagggccctgagatgaaccctgctatcaaagagcaaaatacctgttttaacacaggcccataaaattgctcctggtcatgagagcagggtggccaaattccaagcctgcctttccggcagaaggtacaaccacggatttcactgggataaagtgataagaaaattctatagcagtgactcttggttctttaagaatgaaacctccaataatatattacttcctctgggtgcgacagacacagattaaaacatcaaaacaaaaaaccccttccctccatctgagtcattcattacacactattctaaacactcttgtctaggactttcctaggaccaggaaaggatcggacattttgggcctttttaactctcattttgacaattcactctctaacataatccaatcaatgaaaatattagtacaaaaacctcatgttacagaaatgtatgtcagaagattaaaaaaaaagcaaactcagtggtgactcacttctggacgtgtagtgattaggggtttttgttgttttttaaagagactgagaagggcaattttaggcaaatacccttctgggttacaaaagagcaatgtataggtttcctatatgtcctatttgaagaagaaaatgaaagtggtttgttttcaacaaatacatctgcacaaacaacagcttaccttagtgctactggcatctccttcattccccatccacaaaaaattttaagggacaaatgacataagtgggtgtaactacctttccaggctggagctgcttgtaagaaaaacccttcctgggaagccagaagttccccagagtacgggagtcctctatcagcctccactggaacttacacacgtcctttatttttcaactgtgtgacatcacacccacagctcactaacatctctgtgaggtctcctggtgcctgtgcaaagcccaagcatccaaaatctataaagctcatataaaaatccatgcttacttgcatttgccacaatgctcggcgttacaaatggattaagtacaaggttccttccaatattattttctaggtttatcctctctttctcagctgcctcaaaacaatgcagatcatacaaatacagacagcagatccctggtattaaatcagccaaattagaaaagcgaatttacccacaacttttcaagaatacatccgctgtattacagggaggcacgcgactatctctagctaagtattttaaagaaaacacacagttttaaaaggtcagccgtctggcccacagtgaagtcactgactttaatagctagcttatcgacttgggatctcgtcctgttcactttttccactgggcttcttaaagtttacgtgtgtcatgaaatgcttagctaaagccaaaaggctaagtttttctttctgcagtactaagacgtcgtgaaacactctaaatttaaaagaccatctaccacatcattttccctgtttagaggcgtggagcagtgatgatttccctggttctggttgttgaaatggctgagaagacacgaagtcaagattcaaaaaccacaaagtatttcagcatgcattattgtacacagactatgctgctattaaaacatggaacttccttttcactgaaattacaagcagaaaatagcagatgctgcatgcgacctccatccttgaacatactaaaattttactatgtcaaatggaaaactggctgtgaaaatgactaggccacaacacacttttatttcttttttttaaatcattcgccaaagtccctaaaaacaatgcctcacctcttccacaaggtccatctacgttctttttttttttttttgaaatggagtttcactcttgccacacaggctggagtgcaatggtgtgatctcagctcactgcaaaccctgcctccctggttcaagtgatgctcctatctcagcctcctgaatagctgggattacaggcgcccgccactgcacccagctaattcttgtatttttagtagaaacggggtttcaccacattggccaggctggtcttgaactcctgacctcaggtgatccgcccgcctcggcctcccaaagtgctgggattacaggtgtcagccacagcacccggccccatctacattcaatgtggctgggtgcatcaccccaccacacgcctgtcccctccccaaccatcccactcccatttgcaggtccaggtcatttactcacaaaggatgtgtcttacagggtggaccctagcggcaaattccacttgctaaactgtatcttaaccaaataatgaatactggtacctgtggaatatgagttctttcttttaaagccaatcaccagcaaaggtggttaagagccttgtcaaaagtcaattatcagtaaactctttttggagtttcagttacaggcagaaatctaagaaacaccatgtgtacttctaggtactccacagcctctctgtgcactagagagagacaagagccattcaattcacagagcatcttcacatccaaacagaaaatccaagcccactggtcataccaaattgagacatccacaagatcagctacattgaggcagctgccctatgaaaacagctaggacttagcctaacacttgctatataacgaacacacaatctcccaggttctaccaatcactcctttgacaaatcgaggtttgtcaaagtctctgcctagcctgtcctaaatcaagtgactccaacatgacttccctccaataaacatgctatcattggtagggaggtagaagggtggagaatgacttgcgtctgcatactgcacactaacaaaattaagtgggttttgttctatgccctgagatatagggaaccaaacaaaaggtggtggttgggggtgagagcagtttgctggaaaaggcaggcactcagctatcagatgcaacctgtactccagctaagtctccccaaactggctttcctttctccttactccccaccacactcagtcctgaaatattatcaaagtaaataaaagctgttccaatcccaggtctagtccgcatggctacacaaacatgactctgcgaaactgtgctgacaactgcgtttacttgtggcaaagtgaaccaggatcaataagccaaagtggctttagatttggttaggtttaagctcacataagcacagggagaaaaccatccactctcaaagaactagtgcagaaagcacctgcacaaactcgtcaggatggtttataaggtcacaagcacctgagaaaagatcgtttattcctaggggcatgagacaaatggtaggcctgcccgtcacactactagtgtcaatatttatctaaggcctgggtattcacgatggtataaaccaggcaccttttcaattcagttattcacgtaattcgccactacaaagccccaaaacagagattctttacagcttgatttcttttcttccatttccatacacagggggctggctgcaggacccatggtctatgtcagcaataatccctgcagcctgggaataaagcgtacaatgtatttcagaactacctatatcaaatggcattgcaactgaggacaatgaagaggtggggaagggagacagagcacctgctttcttccttcccatggcaagcatgttttcctcactcgaaatgcgcagagattaaaccctgtagtaaagtaaatgaaccccaagagtcacacctaggcatgtctaagtgtgacttacactgcaggattaattcagcaaccaatacccaaaggtatgtgaagctcaaatagccctgtctggccagttccaattctctccaactccttaatccttcaccccttcctcccttagcctctcctctcccccagataagggcctaatcacaattctctttcccaggtaaaagtcaaaagaaataagtagtccattagtatcaactttaagaggtccaagagacctctgaaaaacagctgtggaaaccaggttcacaaatggatttctccaagtctcttcctatctctcaaagtcctcaaatcccctttttccaagatgccacactgcagttcctcagtcaaatctgctggcctcttcctgcgagacacactgctgtgtaaatcaaagcactagaaaaagatggctgtctctccagggtcacattaaagaacctgcctcaaaacactctttaaaagttgctggctgagtgacattaaatggatttctcaagccagctttctataattcactaaacctagttttctgattccatacgcaggattcttcccaactacactggtatctataccaaaatcctcatgaggactctggatcctctgtgcagcccggtagggatcatcctacttatacatcccagcaggctgcaaaacacttccgttcccttcaaagtgaaattgtgatggcaactgatgcactgtgacgcacgacacacatgtggtctgtgaggagcaggcattcctatctctgctttaaatacgtctgttgagtgagagcaggcaagaactgagcccaaaatggtagcagctgagggtgtggtcagttttatttttttcttacataaaaatatacttaagcagccagtatttcctcacacacgctgaagttaataattcacaaaccaactaacattcatcaaggatcagaaaatttaaaggttgtttgcacaaacactcctgttcttgctcttacttaacagctggtttttttaactgatggctgctgttgccattagggccaggtggcacttcaaaatgttatttcttgagccagacacaccacgacccgggtcatttgccctctggattccacggtatccaaactcctgtgcttaatgttgcttctcagacaaaacaggtaattctggcaaggcaaaaatacaggacaagatgatcctagtttgctggtaaaacattgctgtaatcatgctcttccttttctaatctggcccctccaaatggacaatccccaaagatgccaaggcacaatggagcagtaggtagggctggaataacctcatccaagaggcaaactgtctggacttcagaccaagatgtcttattacaaggagaagataagtttttatacttcagtcatcctcaaaaaggagggcccaatcccctctcgcctcaaaccttatcctttccacctttcttcctttatctcacttaagttcattctctcatttttaaagatgttatcatcagagccagaaatgtaaaatcacgcataggtgtgctggagacacacctatgggggaggaagaggggagaggaggggaggtgatctaataaagccttctccagcaactatttgagtgatgcactacaggataggagtggcctgctgtaggataggaggattaccaaacagatgttggttgttgtttcgaccaaaaaaaattaaaccttgggggtatgagttagctgcaaagccatggacttgctacaaacacacgacacacagcctgagtttgtgggcctgcaatggcttcaaggccgcatcaacatctacataagtcttatgaaagaggttacacattaaccacagcacatctcaaggaaaatcctatcacctccaccatctccacaccgtttatttgccgcctttgaaaaggactttctgcacgttgctaccatggaattggaaataaatggagataaatccagtttttggttctacgtttttgcttttaatacacaactaatttcagtgcatgtaggtggtcctgaaaaggtaaccagttaaccccaatggggcagaaaataacagttaacttaagggcagatgtgtaggacagccaacccatggttatctcgacaggtgtgcgcaggcaggagtttcagggacatgagaaagcagtgtcctggatactatcaagaaagaaaacccaacggtaactcacagttggtttggaaataagcacacaggtgtttattaagcacctgctgcgtgccaggaggaccacacaggtcaataaggtaggctgtgccttcagggagtctgccctcacatttaagactccaaagcaatttcctccaacagctgtttacaatgcagattcccaggccctggcaccataaactctgactagaggactaacagaggctaccatgtcattattatctcacttgtctataggcagttcagcccgctgaccatctccctaactcatggatctccaagggtctccactgtacgggtcagcttttttttccagtatgtccccgcaggccttttctcaagctcaccaccaccctcctgtcagttcatctagaatgggactaaggagtaagaaattaaaaacaaaactcagaaaacctgaccctctacccccagaggcctgcagagatttagtactaactccctgagtagctcaatgagccattttccttctggtttcttgctctaaaggaaaccactgcaggcctcggctccctttcccattaaaagccaccggggccatagttttcaattagctctgtcagcccatcaccctgcagccgcccaagttcaatacgtcctcccttcccccagcttctggtctccaccaagcacttcacacctccctattgtaaacctgtccagagcaattaccctgcctgcacttggacagcctcaatactgcacttctgtctaatttatagctgcaaagctccgtcggcaaaggcagacctgcctcggaacagaggaaatgcagagaaaacggtcaggctcttccataaatgcatatgcacagccaatttccttaggttacaggagagcaaattctcccattctcctagggacactatgtaataagctcccctagagcgtctgtagtctggattcactgcaaggaaaaccactgctctttcctgccacattttctttttcccttgagattccaaacagacgggcaagttatgaggcattacacttctacctgtagatcttcaaagtcttaaaaataaaaactcttctcgcctgaggaagatagagaaaagcacactaccaaccaggggaataccccaagctgcttgaaattgtactttctaaacatgctctgcttaccactgagcaataaaaagacaaaggactcagttaaaatacgggcaaagaaactgaatagacatttctccaaagaagatatacacatggtcaataagcatatgaaaagatgctcagtgtcattagtcattatggaaatgcaaatcaaaaccacaacacaagataccacaacacacccactaggatggctaaaatttaaaaagacagataatagcaagtgctggtgaggtagtgcagaaatgggaaccttcataccctgctggtggatgtgccacgtggtgcacacagcttctccaggaaacagtctagcagttcctcaaaaagtcaaacatagaattgccatatgacccagtaattccactcctcggtatatgcccgaggtatatactcaagtgaaaatatacattcaccacaaaaacttacgcacaaatgttcacagcagcattgttcattacagccaaaaagtggaaataaacaaagtgtccaccaactgatgagtggataaagaaaatacagtctctcctcatgatggaagcattcttcagccataaaaattaatgaagtactgatacctgccataatatggacgaatcatgacaacactgtgctaagtaactaagtaaaagaaagggccatatattgcatgattctatttatatgaattgtccagaacagacaaatctatagagacagaaagtagatgttgccgggggatgggaggaaggaaggataggcagggagtgctaatgggtacagggttttattttggggtgatgaaaatgttctagattagtagttacgcaaatctacgaatatactaaaaacccagaatcctatcattgaaaaggatgagttttgtggtatttgaatcacatctcaaaaaagctatttaaaaaaaaaaaaagtcctgttgcccaccttagcaggctctcagaattccagactgaaaatgccacctagctacttccataccacagaaatgcagaaagaactgcccctctacgtgccaggagataaatgaacacccaaaagaacacccagaaagaacatcagcttctgtgtgcttcccagattgtcctatactcgctcccaagctctgtccatgagtccatcagatgcagaaaacctcagctagagtttaccctcccacagaaaacacattcttggcattttgaaagagcatttcttttcttcctttgagaaattatttagcaaggctgtggaaagcagggctcccagtggccattcaaaaattaagaccaagccagaaggcaggaggaaatgtcaccacaatggggagaaaataaatcagttagattaagattaagatctaacccttttctgtggttggggcaggcggatttgagaataatagcatgctatttctggaaagtccctccagagtaaaagctgggagggtgggggtgtgaaactatatgtttcagtgttagattaaaatttgttgaagttgattgaaaacagatagaaatggccaacggtccccctgcccagcacaggtatgccagtcctctgtggctgaggtccctctatatttcagaccacacctcagcactgccctcgccagcaaagatgcagttaaacgggaaggcccaaagtctaatggggccaggatgctacacaacatcaaagagattccagttgctccccttgcgccataaactctttcacccaacatcattcacactttcagagtgcaaagttcactctgatattggtggctttctcactttgtagcttttttggcaagtgccccttggcctggttgttcattaatatataatcagaacattaaaagcattgtttcaccttctagggaggctgtgcccaatttaataaagccgacattgtccctagggtggggggaaccacctcgaaattggcagagaattcaaagatgcacagaccggagggtttatgtacacacacacacacacacacgtgtatacacacacgcatgcacacagaattaagtatttcaaaagatgttttttatattccccatggcaaaggagcaaaattaaaatgcttctcaccacagaaactgacctggcatttctttcccttaatcctttcaataccaaattactccttacctttaaaacctttacaggaagtagtgatctttgtggcaggaagacaaataaacgagaagggatgtctaaaactctatcacaattatctatgagaatgctcgttcagtgcactacttttacttttcaaagcacatgcatacaatgacaactcactttcgagaccatgtttactttgctgaaagccacattctaaacatgggctcgcttgcagaagggaagcagcttacaattcaaccttgtttatgctccaagtaggtttgacagaaaaaccacataaatttgttttaaaataatttccatttgctggaagctgttcctgaaaggttctcagccacgctaatctgcgctgattcctaccagctgtaggtaccaggcaccctggccacagaccgggcagcctgggcacaggcaggctggctctgcagaaggctgcagcagtacaggatcaacagagccactgcaacagtcccctccgcaacacgcgtccacatctgtttaagaagaacccaaagatgtcctggttcagagtcaaaacatgtgacatgcctgttgagagcacagttttctatgcaattacacctgtgctctctcagaaacacagcttccctagtaccaaagagatgtactgtgctcaagcccaaagaccacagtggaggacagcagatgatgtactgggctgagcatcaacaaaggaaggaaactgaaaaaggaaatatctgggagtatcctgtgtaaagtcttcagcctcaacatccaaagaaatgcagattaaaataatctgaggcaatttccatccattaaactggtacatgattacagaaataaacagcatttaatgtttgtgagggtgtgggacaagcacaagttcacatgtaagttggcagcctctttctcagaggcagtggtaccgaaaatattaagaatctgcatatccagcgctatctgaattgggtaactcatcctaaggaaataaatggctaaacatttatgcataaggatgtctatcaaagcttaggaaaaagcctaaatgcccaatatcagagaaactttacaagttttatgtaagttgtgtaataatttattatacaataaatattaaagcacattttaaaaactgcttaaagtcagggaaaatattcaagatattgagtctttaaaacataactgaaataggtattcagcctcacacattactggaaatttatacactatccagtgataatatttatcaccgaacaatgaaatcagttgttttttcttttgtactttcttctttattcaataaatgcctaacatttgtcaccagaaaatcaaaagtaataaagacatagtaactaggctaacagatcaatagcaccccctccagcaccccccgtaaggccaccaagacagtaatctgcctagactattccagctcactggggacaaaaggcttccctacagcatcacagtccaagatctcgatagccattaaaagaaacatgtgaggctgagctcatcagggagaacacagcttcccattgccccttgctagcatgcctgggagactgcccagagaggagctctgccagctgggttcgcagtgctctctctgccatggatggagatcctgcgtgtctgaggatgggggtgggggccaatgtctcacatctgaagtccaagctaaaaaggcccagatttagaaatgtatctgcctgaagtctcctgccatagaagcttctatcaatttacatagttacttgggctgggtccacagagggcagggtaacctgtccttagtgttctcacagctccctctggtcaaggaaagcagtctttctctctgccagcagcaaagagggagaaaagctaccttggcctggtcatcctttttgtcaaagcagaggcctgagcaaagtaagagctcaagcaaccgaaaccagctgcctggcgagggctcagcataaactgagcagaataaccacaaggggaagggtgtctagacagcctcggtctatggaagaagccaccctcccctgcagtgtcaactctggaaaagcaggctccaaaacgcggctccagcaaaagagcagatgagagaccatgtcaacagctgggaagggcaccgcgggctccctcgccaaacgcaacacagaggagagcgcctgagcctggcccacctgccaaggacagccaccagcaatccagcagggacgaggcgcccgaggacctcatgtggggacagttcacatgcactgctttaactacaaagccacttcagtgacaattcttgcatatgggacttttccaaaattcagagagaccaaaaagaccgccaattctaaatgtggcaggtaaacagcctgtcatcttttcaacttcggttctatttgtttcttctttctttccattcttctaagtttctcaacacttaagagactttggtggagggtggtgaggggtataggaagctactaaacaagcaaggtatattcaggaaatacacagatgaagcctgggaggtctgaattattctatctggcagaggtatttccacaggacatacaggactctacagaatgaatgccactatctctatctacactggtatctgtcacgagcatttaatgtgtcacaggcttcacactagattctgggaatacaatggtggattggaaacaaagccagtcactgcattcagggagcttacagactaatggggtagtcagaaacgaatcaaacattcacacaaaacttctatacatagcactgcagaatcctcacgatgggaatctaacttaaagggaacgtcagccatggtttctatggggagaaacgtttaagacagatgaacagaaatctgcaaggcgaagagggaagacccattctccagacagaggaaatggtgggtgagggacatgggacatggtggtatttaaaaagtctttttaaaaagccccacgtggtggctgggacaggtggggccaggtaagaagcgcgatgaggggcaggtggacagtaacagctttaaacaatgggattcatgtgctccaatttgcaactctgcaaagacccctacagctgggggcaaggggttgcaaacagatgtgagtaaaaagctctctcctccctctaaagtctgcataacaaagtgaaatagtaatgacaaaaaaaatttaagataaaatttatactacaggctaggcatggtggctcacacctgtaatcccagcattttgggaggccgaggccagcgattgcttgagcccaggtgttcgagaccagcctaggcaacatgatgaaaccctgtctctacccccaaaaaatacaaaaattagccaggcatggtggtgcacacctgtagcctcagctgctcaggaggctgaggtgggaaaattgcttgaacctgtgaggcaaaggttgcagtgagtcaagatcacaccactgtactccaacctgggtgacagattaagaccctctcaaaaaaaaaaaaaaaaggaaaaattatcatacaaaattattgataaattccacctttctccttccatcttgctgctacattccttttcttttgaatgaagggtgggggcagtgggtcactggcggccacagcactctcccaggactacgtacatcttacagagccacaaatccaaggcatgccaaagatttcaggcggtgcataaactccatcagcaggctaaactgtttatatgttcttgagttaaaaatacaccactcgggtcagcgttaacaccagggccttatcaccaaggctgtctgtgagctggttacacaaggctggaccatgactcgcccatcttttagatgtgtctcagtctgcaaattatctaacgattcatcagtgagatgatcataaagccaacaaatatacacgcatttgagaaaaacactttccaaacccaaggatactttactgtttataaatagtttactttttttgatccccaagcatataatattcgcagttgctccagaaaccaaaggaacatggaacaggaacacaaaccacaacctaacagaaacaataaacaacagatggcaaaacatatgtgcatgttaccaccccctttaccaaacaggcaaaccaaaaatggatctgacacacacgcctaccaacaaagaaacacgctcttcaagatcacattcaagacaccatgtatagagcaccagctgtacagccagaactacactaggtgcttcaagccaccaaagaccaatcggcctccaggaattcagagacgtcaaagggaggccagaaagaaggcagtgctagtcttaccgtattttcttctaaacatgtacacgcaggtctgaattctaactggcaagtgctagactctaaacaagtcattcaactactctgggcctcatgtatacaacagagacaatatttttcatagagttaagatggtgatgatcagttaacacagatatatcctgctgcagaaaggtacactattattgcgacagttataataataacattatagctacccttcctcaagcttctgcttgtgtgttaggccctgtgttaaatatttcatttttttccttataacaagcttaaggaagtcggcactacaattatccccattttacagaaaaggaaactgaagtggagtaaattgccaaggtcacccaggcagccaggccccagagctgcctcttaaccaccgtgcgtcatgaaccgcacagctgctgcatccccacaaccatggcccctcataaccagatgcctggaatgcaggactctgagaagacaaggacacaacattatcttcccctgaagaccctgaaatactgcactgctctgggcttttcactggttagcaaggcacctgaacttaaagagctcaagacaaacgcttaaattctgattctcaagtcacaatcgactcaactaatgattctgaatagctgatgtttatgactttttaaaaatgtctcaaaacaaacgaaaagggtcacaataagtaagtgtggctatcgtattgttttccatgtatggacatgtctattttaggtatcacagactcacgtccaatcactctgccaatttcacctcaatgctagtattttaaactctgactagaattttccaactacactgtaactttacgcttttgtgtttcttctacatttaaaaagaatgccatttcccaatatataactcccagatgtagaattcacagatgattcatctcacagaacaagtgttctgagacatcagctccaaatagaggaaaaacttggaattcccttcgccctcaaagtaaaaacttgcctagatctgctttgctcaacaaagtttgctttcaattatatttccaaattcttctaacaataactccacggcgtctggcaccaacacatctgattctttgaagtggttctcaagcagaaagtagaaaataaggagaaatgggaaaggaagagaggactatccataatttttgttttaggtcaaatattctctctaaaagttctgacatataaaatcagacaaaccacaagctatgacttctcattgaggggccacactgcaagaagcaacagcaattgaagaaagcctctgcatttagccgctggctccagaggggaaaacagaccctcagcacaaagaaaatggccttttactcctgatatttaaattctaaaaacactcctatgaagtcctccacacaggccaatcaggaaaaattacacttcaggggtaaacctcagaaccccttagagaaacaatgaaactgggggatccgttctgccctgaaagaatgtaccaagctccaagacaaagtggtaaggcaataaacaaataattatcaagggactcctaggtacatgaaattgaatgatccctgctgctttcaagtctaagtggagagaaacacacacacacacatacacacatacagggatgtgtgaagagttacctaatcagatagactcagagattcctccgggaaaggacgagatgtcaacaataaattcaccagaacgagaccaagtgagtaacagggagagtgtgtgacactgacacacgaggctcgaagaagggtgggaacatcatttggcctgttttgagctcagaaagcacaatggaaaaaggtcatctttggttcttaaagggagaattttttttgtaaagtctagttttttggacactctattcctaaagtagtccctaattgttgttaaacttctgtcaagaagttccagaccactaactgttcctccaacttcattgcattttagttgtatccccaaacaaaactccaaattccaagaatttgttccggaaaacaataataaaaataaaaataaattttaaatccggaagtttcgttttatgaaaatttacacgataaagaatgagtggaaggaaaagaaaagcccaagaatttccactgaaggcactaacaaattccacgtcgaagaaaagtggacatccagaacaaagaaaataaaagcttctagattctccatgaaaagtattttaaggagtccaattactgtcataattttcaagattttcaaaaacagtgtaactaagaggtaaccaatgcaaacctaggtagatgggtaaatttaatatgaatttggccaaaaacagagtcagacttcaaaattagaaaaagccacagccgggcgtggtggctcacatctgtaatcctagcactttgggacgctgaggtggatggatcacttgaggtcagtcatgagttcaaaaccagcctggccaacatggtaaaaccctgtctctactaaaaaaaaacaaaaaaaaaaaaattagcctggcttggtggcaggcgcctgtaatcccagctctttgggaggctgaggcaagagaatcacttgagccaggaaggcagaggttgcagtcagctgagatcacaccactgcacgccaacctgggcgacagagtgagactctgcctcaaaaaagaaaaaggaagccactaggctgtacatgttaattggctgagtttctatcttgaaagggatacacgaaagatctccctggtaaaagggatggcaagctggcccagaaagaacaggcagtgcagtgagtagctgcccttcctgtggccatgactatagaatgtgacaggtggcccatccagtccttaaaggcagtttctcagcatcatttacaacttcacttatggcaagtattcactgaaggactgcctgagaaagatgctgcctgcagtggccctgagaaaggaccctttgggaaaacatgcctgtaatttattttcctggttttttttctttaaatttttacctaagttcttaaaattctaaatcaaagatcgaaagtggatctgtaccagcctccacagttttctttgggccagaggggaaaaggaggtaaaaatgaaggaaagcaccactttctttgtggagtattcactcctcctcaataatatctcaaggctcacaaaagggtccctcattgagactctgcatgcacatacccttttttctctttgctgcttatggtatccatctgagaatttcactcagaagtagcaaacattggcctagcatggtagctcacatctgtaaccccagcactttgggaggccaaggcaggaggatcacttgagcccaggagatcaagaccagtctgggcaacacagcaagatcccatcttcacaaaaaataaaaactagccaggtgtggtggcacatgcctgtagtcctagctactcagtagactgaggtaggaggatcacttgagcctgggaggtcacggctatagtgagccatgattgcgccactgcactccaacctgggtgacagagtgggaccctttgtgtgtatgtgtgtgtgtgtgtgtgtgtgtgtgtctaacacacacacagagagagagagaatgtttaagtatcctagatacagatcaatttaattcttaccatccaatgaaatataagtttactccctttttgcttcaattagaatagaatcatgaacctaaaaatgaggggtcttagaaattatacatccctttacagacaggaaatgaagtgactagcccaaggttatgctgccaatcagtggcagagctgggacgaaaccccaacgtctcctgaggcccagccatgagctagtttcccattctaccacatcctcactttcatgactttaagaaaattaattttttcctctcaggtgaatcatttttatgcctctttgggcaagcacccctttaagaaactccatgaaaacgtggtctcctttctgtccagaaagacattctgagcaccacgacttcacataaagtttctcccaagtaaataataaggtcagccaatctttattttaggatagtaatgaaatgaatataatttactcatttctaagtattgtttcaaatgaccttgtgaaagaacccaaaaatctccatagaagagtctctgatttttccattgggtaaagcatagccctggataaggccaaaccacccaaagcaaagagtcctacacagactccaaatctgagaaaacaatcagaggaatttgggatgaggcagatcttaataactacagggcatgtcagcttgttttctggatctcccctcctccaagatggaaggaaaccctgctcccttcgagctgcagcctctgcatccatcacttcattgcatcaacaattcacttcctggaagcaacgagctcttctgactgtttataagttttgcaagcactgggagcttgtgtgccagaaactcacaccagcccaggtggagggaggaaaccacagacacagagaaaaattcttcttaattaaaaataaaacgaaaactaagacggaggcatgatgctgggtcaaggtaccaccacactgctaaaaccagatgaaagaatggtgttctcctaatttgcagaacagcacttaatttcatagaatctctcaatactaagcttttctgccccataatttaaaaaaaaaaaatgcattggagcgtgcttccacttttctaaacagagaacccactgtaaatggtgtataatcggttatcatataaatttaattaagcttcacagatccaccagtttaacctgaccatgttggacagcttttaaggccaccgaacactccataatctacctggaatttgattttcacagatagaagatggaagtcattccaaaaactaggataaagtgaatggaatttggaggactagtaattcccactcagattcctaaatgaagctgcagctagcaaaaaatccattctaaagaagccccctcaccaacaaagtaccggactgaggagaaattaaactatggacttttataaaataaaacaaaccatgcagcagctacttggagaacacattttcaaatctgtgtgaagtttaaatcaagcacagagggttccaggaacctagttctttgctttttgaagatttttcttacaggctgcctctaactctatttaaagcagcctcaagtagccacagctggagggtcaggccttacaaagtaaacaatagttaactcaattcagactcatgacttaactacaaccaacggctaattatccctctactaaacaacagtatctgagacatcactttttaaatgatctattccatttctaattatgtttgttcactaatggattttaatcaacaattaatagcttggtagaaacctcccaagtaagagctatgtggagaaagtggaaggttaatcagaattgcacattctggcagaggactagcacaaaagagcttgctaaacacctcctacaaaagaaaaaaaatctgtattttgagaacatataaactagggtgcacacagaatgtgcccaataaacattctgtaaatatatagcttaccaaaacgccctttggaaaaacacagttaaaatgaatgtcaattttttcaaaacttccaatttcttaaaaccaccctacagtaaatagtatggtatataaattatatctcaataaagctgttaacttaaaaaaaacctatacatttgcagataaaatgatatgcctttgatttatttccaaagaaaaaataaataaataacatggaagggcagcagcatattgggaaatagatcaaataagacagctgatgattgttgaagatgggtgacagatacctagagttcattacattattctgtccacttgtgtagatatttacctttctccatattcaaaaggtaagaaaaaacactccagagcaacagaagtgagttagtttatttaaactacctgcctgcatatcaactgttcccttaattcaaaattttttctaaaagctatgtatttcagatcatctctcaagaaaaagaagctgtacctgcaacagcttactttctaatcagttgtaagttttctctaagcagagcccagcttgttaatttcttgttatccagcccaaagtgctaatgcttgagagacaaatgctttcaaacaaaagagcactggaactacaagatttgaaacaacagcaagattatctatcctccagttcagaagtgttcaatccttctcattgcatttaacaggctatcatcaagtaggtaatccggaagaaaagaagttcagtgcaatgtatgctttgaccaagataagcagtaaaatatttcaatggcaaattataaattggtggaaggagcaaaacagggagggggaagctgttaaatgctgcataaaggagtcttagaaaataaagttgtgagttgttttttttctaatcagctaaaaaaaagaagaaaaaccctgcattacgttcatcgtgtttctcaaagtccagctaattctgcttgtaagagagaccttcactcatttccttcattttcttcccaataatgtgagatcttgagaatgcagatcataaaagataagagattagaacttttgaccacaaaagttcaaaaactaatcaacgcaaaacacttaaaaagaggccatgctttctttaaaccctctaaatgtcaccttttgccaaaacaaactgaacaagcagtaattagaacctgcatcctggttcataaggaaaccaaaatgtattaggacttgcagaaatgaacagattggttgttcgcacaatgggccttaccggttatgctagattaaatagtaataaagacgaaaacaatcgtggccgttcacgtgggcaaggctgtgaatcatggccattcactggggaaggaactcaggtacaggtgcacaaggagtgatagcaaacagtaaacagcttttcaggtggcatccttgccagattcctcaaatgaccctgtgttccccgcctgtgtcccctacaaagttactatgcaattccaaacagaccaaaacaaatgaaaaatgttctttgcatacaactccacaattgtctcctgtcctccctcctccctcctccctcaaggttttccaaagagaagcgggtacagtgaggattcagttagccctaaagtctgtaacttaaccctgtttggaagagcacacctgcatttttccaagctattgactgagaggtgctacttgcaccttggtagggctcagtttcaatgaaaccctgggaaataataggataaaatgattagtttaagggcctctcacttccctgccaccttcccatacctgcctcccttccaaaaggatagtggtaaacagacataactatttgtacaactggaatagatttataaaatacctcaataatttttgctaattatataatctgttgcaactgttcatagcttcctgcctgtttggctaagatttccaagggtacatgaggttcacttgtggcacttcatacatatcaccaaaaatccatgggagaaggccgcttcatacatatcaccaaaactcacaggagaaggctgccatcttcccattccaaaagactccttcacagcagaaaggtaaacatttcccaggaaagcctctgtcaccagcaatctggcttggaagctgggtgtggtagcatgagccttctagtctcagctactcaggcaactgagatgggaggactgcttgagcccacgaggctgaggctgcagtgagtcttgattgcaccactgcactccagcgtgggcaacagagtgaaaccctgtcgaaagaaagaaaagaaagaaagaaaggaaagaaagaaaaaaaagagagagagagagaaagagaaagaaaggaagaaagacgaagggagggagggagggaaagaaggaaaaaaagaaagaagggaggagagaaagaaaaaagaaaaagaaaacagagaaagaaagaaagaaaaagaaaagaaagagaaaaagagaaagagggaagggaagggagtgggggagggaaggggaagggaagaaggaaggaatctggcttggagagactggctgtgagacaggataataaattggagctactgaggcctttaaccttcaaattgtgctccagaatcatcataaagtagatggacccaagttgaggaacctagctaaatataggcatcatctaactttgtcctcacagcttctataagatagagcatttttctgtctttttagacatgaagaggtttgcccaaaatcacacatgtagctgtagactggaggtgccagggatggaccacagaattaactttcaaccccttcaccgccactccttaatgacgagtgtgagttgggtgtgaccaccagcggcaagagcccctgcatatttaacacagtaaaggtgaggaaagctttgtccctagcccattctctcccccagtcaataacccaaatggagaccaggagacagctgggtagcaaatgcccatttagaagatataaagaactaaaggcaggaaatgaaaagtataaaacccagtgaaatggagaaacagcttaaaaaactgaaggacttctatgaacagattgaagttataacttgtgtttcaaaagactatgcataaagtacttaggtaaaaaccattgataacaaattatacaaaatataagaatataagaacatataaagcaaaaagcctttgtataagaaaagttcacaagcatacccaccaccccctacaaaaaagagacacaaattgccgactttcaactagaaattagaccatcaataaactgcaaattttttctgcaatctttattgatccattcattttgcttaataagaatggtcatgtatcaagtatttcagcaaaaaacttctcagtcctagtcataattggacaattaattggtcagtcgggactgctcttctaaactgtgcagctatatcaaattctttgagcaaaacataaatgcaggtcccagaggtaaactattataaaaatgttaaccactggtcttcaaagtgctctatttctttccagaggagataagatctgagtttcttaccaatttccacactttaacttgaaacaaaagcacaagataaccacataactgacatacaagaactgaagccatgaggtagatagaatgaaccctagtggctcagtgtcatgcttaagtcataaaaaataacagtaacggtccctaaatttcccacaggctggtaaacactggagatttttagatatttgcccttccctgcctgggaatttttcctccacccgtcctccctcctgtctcaagacaatgccatcagcctttgaaactgcatccattgtaaacagctctgaatattaacacggcccagagttctgttcgcttttaaaagacccccagggtttcaaattgcagtcactgaggagggggaacgtacccagtgagtaaatgtcacatagctcattcaaaaggaattgaaagttaggcttgctcgtgaaacttaaagtccttctacctatggggtaggtcagaggaatcccttttatgttttaaacaaacgaggaaaagaagaaagaaagactctgatacaaccaacatcctttactgcatataacaactttcaattcaatgaatccctcttctagatttccctctcctgtgcatgccactttttaaataactataggctattttaaacaacctccacccagccttcctatctaacagaccttcagggctttagcaggtgcacagcactgggccaggtgcattgttaagtcacacaaaaccccagtgctctctcctgcattcctgtccaccctgaaagagaggaggctgaagactttgcaccaaggagacacccctgcagaagcgggagaggccctttcattgtgatcatggtgtctgagggagagaaaggtcagccagaggccgtcccaatggactcagggaagctgcagggagaacccaggcaaagtaattaacactggagggaggaaagctttcagctaacggtgcagagctggggagatgggacatgaggacatccactaggaaccagctctcatcacactacacttaatttttcttcatctttctgaagatggttccgagaattactgctgataatatgttcaaaagtccaaagtctgtaaaatctagtaaccaaatataattatgcaaagagacaatacactactttttaaaacagtcccttgaaaagcggggcaggaacagttctgacatgtcctaaaggcaagagggacattgtgtgccaatacacagttaatttacatggggcgctgggaatctctggacacttcctactttagcagtactcaaagaatagatattacggccacaatttcatatcagcaagacttaaacagtgtgcctttttctcacgacaaccaatattatttgccagaaatctcaccttactcaaaaaaagttgtcagagagctatcaacagacaagttatcccccaacaagagggaagacacttgttgcaaaagaaaaggactctgagctcaagctaaagttccctgaaactctaagagcacttgcacctttcagactgtattcttggcaattaacctgtgtttaaaatgctccctattccaaacaacccaggttcttccctgtcccacaaatcggaagacttttgtttcaaagtctgttgagtttaagtgatatggagaaggaaatatttcaggaccatccatacaacaatctactttaaaaaaaaaacatgaatctcagtttaggttccagaacaatttggtgatctgcactttaaacttaatttgcataaacaggatggaaagtattttccaaacccttaattcacaacaccctgcacacctgggccttccagcacagctgtaaaatttgaaagacaaaggccctctttgcttcccaaccacaatggcaaccacagttggtgtttattttctaaggtaatcataagtaccacttctttgccaaaactggcaaggttagatttaagctaactgatctggtattgcaaacacatagtacaaagagatcaaaatcaataaactcatcttaatgtggcttaggataaccacacttggtatacacttttgtgaatatccttgctttagaatgctctgtcatcttcactccacactgagaacaaaaatcagggtttgttcttcctctaggcctgccttcctaatcctaatcccaatcccaatgggctaccattcagctctcaggacatttaaactagcaacattttgtgactaaacactgctgaaatttacggcacaggtaagagtctaaggtaaactgtatttaatacttcttaaatagcttctgaagccatgctctcaaaaataatttcaaagaaagcaaatatctgagttctaagaagttcaacttcttctcaggttctgggaagttggaataaggcttggcagtggcttggtgctatttatgaatgtgctagttggaccatgccaatctcacctacgtaatgggctgggagacttaaattatggcttgactactacaactgtaagttattgtgctgaaaagttatcctcaggccccaaaaatgaaccgattatcattatccattctgtttcttctattcacactgcatttacattcactatttaaaagttttatttttcttatatcaggcctagaagcaacttccacatcagacgcactgtttacaaaaaaaaaaaaaaaaaaaaaaaaggtcccataaagccacaggtcctctgctatctcaaacccacagcctgaagttgtttgaactagctgcagtaaatccagttcatgggtttataaactagctcaaagcattttctagacaccgtgggcttagagcgtgtaaacttggtgaaactacaagatatttcattatatcatatacagacactttctcccctaaagtcttgctgaatcttagccaggaatacaaaccatataaatactcttatggaaattccagaataagactcacggagactaatgatttaaattcagaagtctgaagtctagaaaaaaagaacacatttgcttgatttgtccttaatcagaaataagaaaacttcacaaatatttttcaaaggatagccattttgcactgcatactgtgttgctacatactaaccagaaatcatgctgctcatatcttaaaatcgaatcagtcaacaccataatcagtatactaaagtctactgatgctcaaaatacccactttggtatttctcgatcatcaaatgtgtgagtaaaagagaaggacttcaattttgaaggtatttatgccatgtgaaatgtcactcctaggcaacagaaagcctaaagaaataaccagtatgttttgctccaaaaattaaagggcaaggcaaagtggatcttgtgaccataggaaagtgcaaataagaggacaccctgccctctctgggaagttacttctgtggaactaagtgctttccccacaatgccactgacacatggcattgggagtcactcttccaacaggtgaacacttaagaagttaatctgattttgcccacatgattctatttaaaaaaaaaaaaaaaaactaccgtatgtaagggaaaaatcacaataccccagactaaataagagactacctaaggacaatactgggctctatctcccagtacttcacaaaagctctgcctccaccctacgaccactgattttcactaactcagtaaattccacagaagaagtagatattgaaaacctaactgtaactaaagggttcctggttgtcttcagaactctgtagtacttgttcatggagcagtgtctcgggccaagttaaagattcgtgccccattttgagaggtacaggatctttacatttaaaaggaattaacttttcttcccttcacggtagtcagaacacaggccacattttcttcgatcaagccacaggtgctggttacaacttgtgacaccagttttctctttttaaaacagccatagtcatgcctaaggttactgctgtgcctttcctatgttctaggaaaaatgtccaattattcaaccgaaatgcggactatttaagctaggccttttctggaaaggtactaatggttctacagagatgctaattacccataactgaacgggatttgactcatgcaccagatttgttagaagtaaaagaagactattctattctaccatgtttacacagaagtctaatgccttttttttcctgtcaaatctcctgtaagaagtgtcccactaagtcctaataagcccacatcctgacagcacagaaaagaacctctttcgggtgaaacaaacagcttaaatcagccaagcccctggcaccctctcctgaagcagcacttctccaaaactcatttgcaccatttatggaggagagagtcttgagggtgggccccaccccactggatcatcaagcccaatggggccccagggaacacacaggaagggtctggaacacagttccgtaaaatgccaaacaggcgtaaaaggacaaactcccagcactcacaggtcgccaggaactgtcaaagccctctaactcaggggtcctcgggggaagactgccttctgccccgcacagagaggcaagtcaggccaccacggtcttcggggatcaggagacggctacacacactatcaactaataaataatgtaaacgaaagactggacccaacagtcaccttcattcattacccactggaagaccaaggagctcagacaccaaatagttggattacaggagaggaaaaggaaacgcacccacatacccccacagacttcttcacactcttctccagacgtttcccacccacccacccgcaaacacactcagctccagactcccactcactcacccccagatggcccgcacgacgcgtgctggctaacccccaaatctctacgacccacgctcgctcgtctccagaccccacgaggcacgctcttcttctccaggctctctcgcacgcctactcccccggacctccacgcagaatctcccttccgccactccaacctgacagtcttccaacacgcacaagcacgcacaactccacacacacaacccagtccgcaccccctccctgagtacgaacccccgccgctccatccccaagtgacagagccccggggcgcagagagggcggaaagggcggcactcacaggctccgcgtccaggagggcaggtccccgggcaacgcagccagcccgcgcccaccgcagtccagcgagtccccagcgcaagtgcaggcggccgcgcagggcgcccgcgggccggccgcggcggtcaccggctccagccgaagcaaaagcagccagagaaggagaaggcaaggcgagcggcgcggggccccgagccctccccggaccggccgcgccatcttgtctggagcgcgctgcgaactccgggcgcggggactgtgaggacccgaacggccgcagacgcgggcgggcccgcggggcgctccgctcggctctagactccgcaccggggcatggcccccgccccaagttctctctgcggccgcggctccggcactcagcgtgcccccggtgcccgggccgctccggagcacccggcgggggccgcaaaccccgcgcccatccgggccggccggcccgcccgcgctagctgcgaactccgccgattcgggcaaggtgtacccagcctgcgctcttcgtccgcccggggcacgccgagtgccgctaccgacaccggccgagggcagtgctgccgctgcgcctggaagacaggcgttcagccccgcagcccgagctcggtgccggcaggcatcttcctctgggctcggagcgcaaagccgtagacctcgggctggacggcgcggccggccccgcgctgggaggccccagtgcgcctcgctgtccccacgccgcggccagagagcgcgcgcgcgcgcgcagcctcgggttccgcacggctcctccgcgcagcaagagtcccgccgacctcgcagccgaacaatcagccgcttgctgttcgcctccccgcggcccagccccggccggtcccccaagccccgcccccggccgctcgcccgcacacaccccctaggctccgcgctccgcggccgcctgctggcccacgttggatgctttgcaacagcgccccgccacgcctccccgcctgctgctcattggctgccggagtccaccgtggccagcctcgagggccattggagcgctcgctgtgatcccgcccctcccgcttcaccggctaccccgcccccacactcttttcccacccaaggtgtgaagggcgggagactgggaggagaaagggagggacggcccccgcctcttaaaggagacacgcaggttgttgttggagaacgggaacgcgggctggggaaaggaggcgtgaagatacgccctctgcgtcaagaaggggagagaaagttaagagggtaaaacgcccccgttttggggctgtctggccccaaggctttttacgtcctcctcaggctgcaagcaggactgcagattagaagcaaacccgcgtccgttttccaggttccttccaaaagcgaagacacaggtttaaaacttaacacatttcttcctgactgggacatccttggttatttcattaggcgtggtccccttcctcctcgagcagcctggagcatctgctcctgacttgttcttcacgtcctaaatccagcaatatgtccttgattactaaaatgaatgtgtgctgcagaaacctagtctcaaaggtgcaccctcggccaggagtggtggctcacgcctgtaatcccagcagtttggcaggccaaggcgggcggatcacctgaggtcaggaattcgagaccagcctggccaacatggtaaaaccccgtctgtactaaaaatgaaaaataaaaaaattagccaggtgtggtggtgcacacctgtaataccagctacgggaggctgggacaggagagctgcttgaaccccggaggcggaggctgcaatgagcagagacttgtcactgaattgtcactgaattccagcctgggtgacagagcgaaactccgtctcaaaaaaaaaaaaaagtgcactctccttcccagctagtgagttgaagggtacttctagaaatgctgcagcctttgataaaggggttgctttgttgttgtcattgggtttttgttttaatcagagtctttttaagataattttcaagaagccattgtgtattcgtaagagacagagttaaaggagaaataatagttaacaaagcttctaacttttgctcttaaagatcagaccatagtagtagtgtgttacgatagtacgtggtaacattaagcagacatacacacattgagaaaaaaagaaaaagattaccactgtaacatatagctgccctctgggcgttttggtttgctagtgtctcatatcccttcccaagagtatgcaaattactaacataactgcgcacattgtcaggaagattaagcaggtcaagtctgttgaaaaacatttgctccagaacattaaatctgagttgtgttttatggaagtggggtggggtgggaggtaaagaggagaagttgaaccttagggaaaaaaggcaaaaaaaaaaaaaaaattaaagggtttattccattttcgacacaatctaagaggtttgctttaattgagatgcactaaatgtgttaaactttccctcagccataagatcacctcttttctttagccaaaatgtgatcttcctatcccttcctcccctttttccttcttccccttctgaattcattgcgcctcatttttttcttgtttaattttgcatgatctcagcagtgatgcccaaagcagtgctcaaatatgtgggtaaatcaattcaaatctaattcccaagaaatattatcagaaaaatgctgcacctgacccatcccacccagagctttaaccagcttttatgtttcatatgtaatccaaataaacatacaccttccatctggacgagaagaaatatgtccttttgttctatcccttttggtaaatataataataataagcagtgggaatggaattaaaaagaccctaaatttatgaagtcctctcagtcagtgtttaagttttacacaaagaacacaaaacagtaatttgatgcagaatacccacagccgtttcctgaaatgaaactgtcagatcctccctgtccccaccccacaataaaacagcatatgcagcaaaaaatgaattgaactgattgaactacttgagatgctgacctaaaattatctttcaggtttgtctcatttctagtactataaaagtgggtaattcttgtaaaatgttttttcaaatgtgtatgggtgtacttgtgagatgcctttttggaatcttagttttctggaggatagaatttaagaatctgcaaggtgagggagtgcccacaaatctaaagcatcccttgtggtctggttaccatgcagccagagaaaaggattccaaagccggggcacacttggggggacagggcgcctaagccttggcagttcctctcgtctacagcaaagcatgaagtcatgtctgctccccataccatgtatggaagtttgcccacatactagcaacctgcttgtgattgcaatgagagtgtgaacttggagagcagtgatatccagctcaggggggaattcatctgcagccaccacctaagatgaaggagatctcaacaacaacaacagcaaatgtctaagggaatctatgtctctgctcataaaagtgcaagtcttggtccattcagcacagagcaacagttgatttgggtgctgtaggtccttattttcctcacactgcaactttgatctttctaaatgcttattccttaaatgagtcatccggggattttagattttccagttcattttcatctaccccagggatagcatggaatcaaaccccagtgagaatctctgcaggtctctcttgactccagaagccctagcagttaatcatcctaagttaatcatgcttgagagaggaacccaaaatctaaatagcctgaaatctattggggagagaagcaaataacaaaataacaagaaagaaggttaaccataggaatttttttttttaacacaacttcctggggactgaatttgtgccagtttgctatagttctaggtggtggtctttagtggttttaaagaatgctgagattcagaggggctttcttaatgttaggtgagattttacactgtgttcaatacattaaaaaagcaccaggtcaccattcaggagagctgggttccagccaggccttgttatgggtgaaacctttgaccagtcattttctgtcttggagcctcagttttctcaaatagaaaacaaggggctgggcacggtggctcacgcctgtgatcccagcactttgggaggccgaggtggggggatcacctgagatcaggagttcaagaccagcctggccaacatggtgaaacctcatctctactaaaaatacaaaaattagccgggtatggtggcacacacctatagtcccagctacttgggaggctaaggcaggagaatcgcttgaacccgggaggcggaggttgcagtgagtcgagatcgcaccattgcactccagcctgggtgacaagagcaaaactccatctcaaaaaaaatatatatataaaagaaaaatagaaaacaaggataatggtacttgacctgggtgctgagtgagtaaagaaggatcattttgataaaggaccaaaggggcattataaactgtttacatctcattgttttcaaggtgttattgatttgttaactctgaaaaactgagagcccatatgtataatgtagatggaaaatcttagcaggttgtttcagcaggaaagtttcttgtccaggaatgtgacaaagggttaataattagctatgaaacccctgaagacttgcagggtgatgacagccctgctttgagcctgttttctatctctcttccaaggaaaataaaactgtgtactcattaactccttcgtcgcaataatcttgtcaaggagatggatgggtggagaaggtaagagaggaggctaatgagtctgggaatagaatataaaaagagaaagattttgagatctccccatcccccattccaacatttgcctttggtggaggtagttttcttgtgcaatctctggctattggaatattggttaatgcccagacagtgccaagctgcagctgctgcagttccacagcaagaatggttgttgcctgcagctcagctgtgacccttcacaggatctgccctcctccacagagcaccatcgacaggggccaaaaacctttagagtccactttctaacacaaactagaaccttgacacttgtccttgccttgtgaatgtgaaatgtttactggttcactgaaaggatgaaaaaaaatatgtcaaaggtatgagcatttcataattctgagattgagattctggagtaatggtcattgtaggaggcagtcccttacctctgacggtgatgatgatgggatggactaattacatcatcaccagagaccgcacctctcactcccaatctgctgcctttgcaaatgtcactccgagaagtacatgagggcgagtgcagggaggattcaaagtttatgcctcactgccaaccactcagaactaacactgcaatgtatataaagaacagcacattgatcataacataataataatcttatgaagtcatataccttacatttttcaaagcactgtcacatcataacaacagctatcatttacggagcactttttatatgtctttcatgttgttgagtgctttatgtacttttttcagtgaggtaggagctaagaaaaacgtttaaggccacacaagctaataagtgacagggccaagattccaaaccagttctgtggacaccaaagatctattttgggctgggcacggtggctcaattcctgtaatcccagcactttgaaaggccaagatgggtggatcacttgaagtcaggagttcgagacaagcctgaccaacatggtgaaatcccttctctactaaaaagaaaaatattagctgggcatggtggtgcatgcctgtagtcccagctactcaggagtctgaggcaggaggatcacctgagcccaggaggcagaggttgcggtgagccgagatcgagccactgcattccagcctgggtgacagagcaagaccctgtctcaaaaacaaagaaacaaaaaaccccaaagatctattttgacatttgagcctcctaaactttgaatatgaaaattgttattgttcccactttacagatgagaaagctgaggttcagtgattgtcccaaggtcacgcggcatcaggaataaatagaatcttaaatcacaagtttcatcacaaccaccagcacacatattttatattcagtgaatgtcttacgaagtgtatcatggagcttctttctcagggatgccatgagaatggatgtgatttctttactttttcatatttactaatagattttcaaagttccctctatgattaataagttaaaattttaaaggataaatatctagacttttctctccccccatacccagcagtacttgtataacaacagtggttaacattactgatcacttactatgtgctaggcattatttcacatcatggcttaatttcactgaagaattctatgagataccttagagattgtcatcttacatatgaagttactgaaactctgaaatcaatccccttgcccacattataccctaattaggtgctgagcaggaagaggctcacagctaacctaccccaatcacactccctctcttatcattctcacttttgattatttttcctgtttatctcttcctccagtctagtagctcagtaagttaaaagtaagttaaaagactgagtctaaatcccttcttggtattcctgttgtctaacacaattccaggcacatggtaggcacagagacaatatttgctgagtgagtcctgcctgccctgcaaggagggagaattatcaagcctctttcctcccccattttattttatacatgcttgctattcacatatgtgtgctgaccacatcaatattacctggagcttctcagaaatgtgaaccttaaggctgggcacagtggctcatgcctgtaatcccagcattttgggaggccaaggtgggcggatcacctgaggtcaggagttcgagaccagcttggccaacatggtgaaaccctgtctgtactaaaaatacaaaaattagccgggcatggtggcatgcgcctgtagtcccatctactcgggaggctgaggcaggagaatcgcttgaaccagggaggcagaggtagcagtgagctgagatcacactattacactccagccttggtgacaaagtgagattctgtctcaaaaaaaaaaaaaaaaagtaatttcaaaaataaagacaagcatgtggctgacattattgcacctaaattgaagcgcatgcaaaacatctgctgcccatgagattttggtaaaatcctctcgtgccattcaattctcttttccttcaccatgcattcagactaataaaaagcatttgcaaattttatagcctgttatatttgtttccaaaaggacagttgggtttatgacacatttcaaatttattataaacctacagacagacacatattatatgcttttcactgtcattcttatccatgagctacattctttagataatcatttaaatatccttatttccctgggggagcttgacactcctcttggatttagatgctataaatcaaagaaaagtctttgtcttttccgcaactctttcttatttgaagtgccttgactggttactatttggagaaggcagctgtatagaataattgtctgccgacggccactagcagtttctcccctcaagaggcaaagtctattttctctccctcttaaatctggattggccttgtgcctcgctctgactgatagaatgcagtgagagtgacgctcttaccagttctgggcctggcagctttgtctctcacccacttcctacctggagctgtcatgtaaggaagtccaggctgccctcctagaaatagaggccctggaggagaagagaccatggagagagagaggcaacgtgcaagaaaactgggtggcccagccaacagccagcatcataaccccagacatgagagtgaactcattttggaccttttagcacagaccagctaaatgcaactgcacaaatgagcctcgccaacatcacatgagcagggctaagccatccccaagggtctttcccaaattcctgacccgcaaaatcatgaccaataaaaaaagctcttgttttaagccactaaattttggggtgacttgttatgcagccatagataactgagataacaagtgtggctaagtgagcatgcaataaaacgtgagtggattttgggggaggaataaaatctaatcaaataaacccgtcatcaggagtgtcaaaaaaattagtgttatcagctgaccttcctgacgtgtttgtcagggcccttgattgaacgcaacaggctaactggctgatgccatcgaacaaaacttcttagataataaatattctggttcttcagcaggccacaaaacaggttcccttccacttctcttagaaacaggtatgagagaaatgcagaggatctgcttatttataaaaggtatgttctcttatgtaaccccatggcatccaggtaaaataactgattgagaggatgaaataattgaagatctattcttcccgaaaagatcagataaggcttaacgtgtttactccatttttcatatgggacaaataaatgaatattttaaaatggaatcctagccataaaactgacactgagatacagagtttgggggtatgctttggtagcgggtgacagtggtggggattatatctcttagctgtgtgctaacctttaagttctgcaaagcatagcttactgcctccttatatattgtcttgcactcttctccagctctcatttcttagaagccatcactgttaagcagtgctgcttacaaaatcaagttagctaagtccctgccatcagagagtttataatctgatggtattgttgactgctaggtccccaggatctagaacagtgcctgacaaatagcaggcattcaatacatattactgaacgaatacatgatcaaatgaatgaacggttttctgtatgcaaacctcattttccagtcaaggctataagcagctcacaggaagcaggccccagagccacagactattggaagacaaagggatttcgtgtctttgagtgcagtaggtcagggtgaagcctgccggatcatcagatctgccaggtcagaaacttctagtgaccaaccacccaggtttggaactcaggggtttcccaggtcatgggacttcaagtgctaaaataggaaagttctggaaaaatcaggacaaattggccaccctaattgtaattctagtttctaaatgcacacttagaaccttttgcatgccgtatagctaagctatatgagaacctactacagtatgcaccagggaataacttgagtggttcaaatgcatcaactcatttgatcctccctacagccctatgaggcagaactattaaaatcttttctttctataaaatagaacactgaggtgcagaaggaagtaatctgctgaagatcacacagctaggaaattagactccagagctcacactttattattattattgttattattattgagacagggtcttgctctgtatcccaggttggagtgcagtggtgcaatgtcagcccactgcaaactccacctcccaggctcaagcaatcctcccatctcagcctcccgagtagctggactacaggtgtgtgccaccatgcccagctaagtttttgtatttttagtagcaacatggtttctccatgttagccaggctggtctcgaactcctgagctcatgcgatcttccagcctcagcctcccaaagtgctggaattacaggcataagccactgcacctggcccagaactcacactttaaaccagcactctcgtatactttattatagtagattcccagctccttctcaaaatttgttttaaacctcattcttttatttgtattcataacacctttcacagtttccagttatttttagattttgtcagcccattttgtatctgactctttctaatagtagggctggagcctgaggccagggacctccactctacccctcagggtctctcacagcacctggcatgagaaaggctcaggacagatatgcggaatgaatgcagtagacatgaaacctctaggttgactgaaggactgattgaggtagatttctagctcaaagggaatctaatattaaccaacatctaccatgtttcagccatcatccaggtaaaaacgctggccaaacttgggcttcaaggggattaatttggcctgaagtgtttatttttaaaaatttgaatttgacctgcctttaggaggtaggcatctgctgtcttaatttatatttcctgcctgcccaccccaccaggcatttgagtttgcaactatgatcccagcctttctctaacactcattcatttatcctttacagcaagcctctgtagtaggcatttccgtcggctgtttataaataagaaaactgaagcttggaaagcataggtaacctggccaaggtcaaaaacttatgaaatggggaatagtactcaactcagggctgactcctcttgctatatccactccttcactcctcagccactaagttcctctagccaacacatgaatgagagacctattacttctcagtcaacatatctgttttacaagagtgtggcttctacacagagtttgactccacctgcattcaatacagtcaatccaaatgtgtcccagggtctcctaaatgtttctctcccatgattcaccacctctcccatgccccccagtagaacatggtgttctggaagctaagtaggagggatagttcactgtgggaaatgcttttggaagatctaggtgaaaactaagaactgatcattggatttagcatcagatttattgtaaccttgacgatggctcttttggtgaagtagagagaacgaaggcaagattagagtattaaagagagaactgaaggtaataataatttggcacaatgatgacagcctttttgaggagttgtgttatcaaagctaacagagaaatgggatgatcgctggagagggaagtggagtcaggagagtttgttttattttgagatgagagaaataacatggcatttttaatgatggaaatacatttgtagagaacagaaaaaaatcaataatgtactaagggaaggggagaaatgtgagagcaatattcttgaaaagccaagagtggacaaggggagaggatgattttaccttggaccaaagagtcttaaagaagctggaaggcagattacaggcacaccttgcatatatttcaggtttggttccataccactacaataaaacaaatattacaataaacagagtcacaaatatgttggcttctcagtgcatacaaaagttatatttacattgttccatagtctattaagcgtgcaatagcgtatgtctaaaataaaagtacatatcttactttaaagatgttgtattgctaaaaaatgccaatgatcatctgagccttcagcaagttgtaatctttttgctggtggtgggtcttgcctcaatgtttgatggctgctgacttatgagggtggtggttgctaaggctgaggtgattgtggcaatttctgaaaataagacaacagtaaagtttgctgcatagactgattcctcctttcgcaagatttctctgtagcgtgtcatgctatttgatagcattttacccatggtagaacctttaaaattggagtcaatcctctcaaatcctgcctctgttttatcaactaggttaatgtgaaattctaaattcttgggcatttcaacagtgttcagagcatcttcaccagaagcacataccatctcaagaaaccactttctttgtttatccataagaagcaactcttcacctgcccatgtttgagcatgagattgcagcaattcagtcacatcttcaggctccacttcaaattcctgttctcttactatttccactgcatctccaattccttcctccactgaagtcttgaacccctcaaagtcatccatgagggttgaaataaatttcttccaaactcctgttaattttgaagaacattcacggcttctaaaatggtgaaccatttcaagaagattttagatttactttgcccagatccagtagaggaatcactatctatggcagctgaaatacattatgaaatatagttcttaaataataagacttgaaagttgaaattactccttgatccatgggctgcagaatggatgttgtgttagcaggcatgagaacattcatctccttgtacatcttcatctgaactcttgggtgaccaggagcattgtcaataagctgtgatattttgaaagaaatcttttcctctgagaagtaggtcttaacagtgggcttgaaatattcaggaaatcatgctgtaaacagatatgctatcatccaggctttgttgttccatttctagatcagaggcagagtagatttagcatctttttttttttttttttttttttttttttagtagagacggggtttcacgtattagccaggatggtcttgatctcctgacctcgtgatccacctgccttggcctcccaaagtgctgagattacaggtgtgagccaccgtgcctggccagcatcattcttaaaaactctaaggttatcagaatggtcaatgagcaatggtttcaacttagaaagtcatcagcttcattgaccctaaccaaaaaatcatcccgtccttcaaagctttaaagccaggcattgatgtttcttctctagctaagaaagtcctagatagcatcttcttccaatagaatgctgtttcatctacactgaaaatctattgtttagtgtaggcactttcagctatgatcttagttagatcttcctggataatttgctgcagcttctccatcagcacttgctgtttcaccttgcacttttatgtcatagaaatggctttttccttaaacctcatgaaccaacctcttctagcttcacacttttcttctgtagctttatcacctctgtcagccttcacagaattgaagagagttagggccttgctctggattgggctctggcttaagagaatgttgtggctggtttgatcttctctccagaccacttacactttctccatatcagcaataaggctgcttagcttttttttaatcattcctgtgttcactggggtagaactttttctttttttcttttttctttctttctttcttttttttttttttttttgagaaggggtcttactctgtcacccacgctggagtgcagtggcgtgatcttgactcactgcagtctttgcctcccaggctcaagcgatcctcccacctcagcctactgagtagttgaaaccacaggcatgtcccaccaagcccggctaattttttgtatttttggtagaaacagggtttcgccatgttccccaagctggtcttgaactcctgagctcaggaaatccacccacctcggcctcccaaagtgctcggatacaggtgtaagccactgcgcacggcctgggatagcacttttaatttatttcaagaacttttcctttgcattcacaacttggctaactggtgtaagaggcctggctttcagcctatctcagctttcaacataccttcctcactaaacttcttatttctagcttttgatttaaagtgagagatgtgtgactcttcctttcacttcaacacatggcggccagtggacagttattcattggcctaattgcaatattgttgtgtctcaggagataggaggtccaagaagagggaaagagactgggaaattgtggctgctggagcagtcagaacatacgccacatttatctgttaagtttaccatcttctatggcatggtttgtggcgtctccccacaataacaacagtaatatcaaagattactgatcacagatcactaaaacatacataataataaagaaacagttaaaaatattgtgagaattaccaaaatgtaacagagacacaaagtgaacacacgctattggagaaatggcactgacaggcttgcttgatgcaggattgtcacaaaccttccatttttttttaaagcattatctgcaaagcataataaaatgaggtgtacctcattatccagtgcaggtagccatggtggtaggagtttccggctattctctctctctctctcttttttttttgaaacggagtttcactcttgttgcccaggctggagtgcaatggcgtgaacttggatcactaaaacctccacctccctggttcaagcaattttcatgcctcagcctcccaagtagctgggattacagacaaccaccaccacacccagctaattttttgtattttttagtggagatggggttttaccacgttggccaggctggtttcgaactgctaatctcaggtgatccgcctgcctcggcctcccaaagtgctgggattacaggtgtgagccactgcatcccgccttgctattctcttctgattgcttctattttcttaatgaaatagaaggcaagatcattggctgagagggagaataagtgatggaggttcaaggaaacatgagaaggtaaaatagaagatgtggctgtaaagaggcatgcttgattgtaaaggggttgctattattagcaaggtaaggtatgactgtgggagcaagaagctgagaatagaagagcaaggtcaagcactcaataaatgtttgtcaaatgatgaatgaaaacaaaatcactggagatgatgtgattcaaaatgtgggaggccaggagagtgaaaagatcatttgcatggttatgaaaattaccaagaattatgacagaaagattactgtgagagtgaaagtgggtcaagagttaaaatctttttgagggtcagtagatgagtgctacaaggtaccagagggtttgggggggtgtggatgagagaatctgaagtcataagattgagccaggaacagagggtcatgcctgtaatcccagcacaggaggctgagtcaggagaatcccttgagccaaggagtttgagaccagcctgggctacttagtgaaaccgtgtctctacattaaaaaataaataaataaaatgtaaaaaacttagttaggcactgtggtgcatgcctatagtcccagctactcaggaggctgaggtggggggaatcacctgagcctgggaggtcaaggctgcagtgaaccatgattgcaccactgcattctggagcctgggtgacagggtgagacccttctcaaaaaaaaaaaaaaaaaaaaagaaaaagaaaaagaaaaaatattatttattaagaaaattataaagaagataaaatatatttactacttaagtgctagtggatcatcataaaggtctgtattcttgtcttcatactgagtaggctagaaggaggatagagaggaggagttggtcttgctgtctcaggggcagcaggggcagaagaaaacccatgtataagttgacctgcgctgttcaaactcatgttattcaagggtcaactccactgtactccaccattgtatcgcaaaagcagccataggcaacatgaatatgaacttattcatttagaatatgtgtaagtgcattccaataaaactttatttacaaaaacatactgcaggcctgcaggtggaaatctgcttactgcagatcaatactgctgaaaaagcccagctaggagaaggtctaatgaacaaaaacagaacatgcttgtctgaggaccaagaataagaaggatataaacttaggatcctggttgcaagcagagtggccatgtatagttgtgaagtttgttcactgcacaaccccagggggcactagtcacatagattccaatgtcagtgactaccctagaagctgtgcagggcataatctttatagccacatttgacagtcctagttgcaagcatagtaacttcaaggattttatataatgaaagagttaataggagcctcaagcctgagaagatatctctactctttctagaaaaacaatcattgcttttattgagcacctggcttaggaatatataaacattatctcatataatactcctagcattgctgtaagttatattttcctcattttgctttaaggttcagaaaggctgagcaatttgcctaatgtacccagctagtaaatatctaaaccaaggtttacctgactcccaagtctgtattcctcctattctcctctcctttcaaactggttacaaggttctttaatgatgacctagtcaaacatatattaaacattttcttctggaaacctaattaaaggtaattatataccttacaagacactaaaaatatggcaggcacgccaacaaagcagacagttcttattatatcaatgtctttatggatttggattctgttcagaaaagctcaggctcaaaaggtaattgctggcagcatgcaaactccatcaacccataattaacatatgacaattattctaattgcctcaaacaacatttctatgtttttaattgtagagcaatttgccaatagcattgttaattggcaatttatattttaaacatgcaaaggacaatgggtccttatttcctctgaggcaactgcatgcattaattgaattttaaaaatacgttttcttcttttctctgaccccaggacctccttcagatggttctcattgcagttccttctggccaaagtgtgttttctctaggtaacttaatcttcctttagcactttaatacattttcctaacaattcacttagaccagatccttgtttctctctagacaccctgagcagggctcctgttgacttcaaagggaaaatagtgggtgcagggaaaactaggaatctggttcctggttcaaaaaacctccacacactataaaacctcactggtgtcttcctgtgtgttaagggccaattaatacatgtgattgaagcctttgtatgaaaccaccctggcaacttgtgaacttgctgggaagcacagcagccaatacaaaacaatgtttcgtggacccagttcccatatagaccccccatttactcatagggagggaatgagaagagtaggaattgcctcaaaaggcagaaaagcaataaagacagccattgactctctctttcactgtctcctcctctattccttcaacacacaattataaaccactttgaaccaaacacttggctaagtatcaaagattaaaattaatttatcacccaagtatcaactcccagccccaacattaagggtcactttcctctgtttgggaacgaggtggtatgccttaaagctacatgagacagcctggcacagctcctcaatgttacagaatcttccctttgacctgctggctgtcacctggaacttccaaactcagccctgccatgggatgctgcttctcgatgtggacgttagtggaggggagcaggatgggcaaggtacctttagcttgtcccttcttgaccccactgaaaccaggaccaggaccaagacctctaccttgtaaagttgttctagaatatgagaatttagggatgacctagaagtgactgtgatggaaattgaaagacaaaacttttaataatgtcaaactctttttaacttaatataactgctctccatagacaaggggaaaggagagaaaatccaataccttaacagagatttctagcctggcattgtttctcagacttctgggcaccctggtcccaagaccatctcctgcaaatacagtggagctgaactgtgaatccatattaactgaggagctctacctggaccaattaaatcagaaaatctggatatgggccctaggcatcagtatatatttttctttccccaggtgattttaatatgcagctaggattgaggctccttgcccttggataggtcctgtcccaccaccaggccatggggtagagtaggggtgggtgtgtggggggacaatgtcagcataggtcccaaagctggaattattcagtctagaccggagtttgcacattgaaagcccacccacaggctggatccagccagcagatgtgttttgtttggcccgcatggggttttaaaaaaatgaattacttgccaacatttattaatgagaaatatattgcagaaaaatctggatatctggcttcttttggaaaataggaatatctgactattcttggtctgaatttctgtgtgacaacaattggctggagggaaggagccacaagccctttaagtacagcctgtgctcttgggttcaccatagccctcaccactctctattatctcacaccagtcccaccccactcatttacctccctgacccatgtagctctacctaatggggcacagggaaagagaggaagccttgtttccctttgtaataccctccccatgaagtgcaatccaaggactgacatccacaggataagaatggagataaacacaagagattaatgagaattacagaacagaactatttttctatatacaactgaaacaggagagttccctgattcccctcacaggacatgcaacaagggtgtggctcagctgttaccccaacggctcaaacccctagcggaaacatgaggatgggcaggtacagaggctggggtgagtgctttggtctctcagctctgtggtattgtctaggggtgggtgggtgcctgcactccagtgttaccaagctctttcagctttgccatctgtagacagcttgtgtgttaatcagctcgatggaccctctgccttaccgcaagggcagagggccagtgtgacaggcttctgtatcctgagctcttgcccagtgtcccaaaagaatcggatcatatgtgggctagaaggattagtgcaaggttttattgagtgatggaggtggctctcagtgagatggatggggagccagaagggggatggagtgggaaggcggtcttcccctggagtttggccgcccagcagctggactactctcctactgtccccggccacactcccctcagcgtccagaagtccctcttctctctctgctgtgtcattcctctctttctctctctcatcgttctgctgttgctggtctgttggtctgctggtctgcaggtctgctctggagcgtagagtttgggatttatatgtgggcaggatagggggtgtggggggccaaaaggtagctttttgggcacaaaaccagaaatgcctgttctcatttagggctatggatattcaggcttgagggtggggcctttgccagggaaccaccctcttgtacccagtatttccctgcctgttgtccatatcccaacttaatctgcccagggctctgcctacaatggagaatacttaatattgtcatcacagagtaggattgatttgaggcccaacccatttctatccttacctccacctccgttcttgctcaacctcaggtttgagcttgcataggaaaaaatcccaccccacacccttagagtatctacccactcaatgatagacagttaccgtttatcagtgccttaggctaggtcaggttgccagaccagatggtcccacacctgtcttcctggaccagtatttctcaatgtgtgacttccacacctcctggcagatttctgtgtcccactccagatttactgaatctagatacctagaggtgggaccaggcatccacatttaatgtgcccagtgagtgttctgctcaataatagcaatagcagctgcacttactatgtgctttacatgtattgcatcttcacaaaatccttgagttgggtagtagcagcgccactttgcaggtgaggaaaactgcagcacagagaagttgaataacttgcccaagttcacaccgctgtaagtagcagagctgagatgaggctcatctgttctagttggtaaacctctgctctaagcaatagggtggcaagtgatgaattcgtgagcccccaggccaagtcgttcaaggaagatggggtagagtttgtcaattacaatgataaaacataggccttgctttctgttactagaaattattttgaggtagagactagacaaaagcatcttacccataacatatggtagcatatgatgagatgacaaaaaatatcctgtgtcccataggatctgctctctgcttgtctctcagactttaattccatcttccgtctttaattccagcctctctgctgtcctcctggtccttgtgctgggacttagcatgtgttgttccctctatctgaattgatggtgggtgggatctggttgggggtcgtcatttgccacactctgccttggatctcacagacagctctttcttgtgcctccagctctgctcagctcggctcttggcttctcagagaggcctttcctgacttccctggctaaagttgcctctttcctcctcctagtcatctctttctcatcagcttaaaaaatgaatagcgcttattatcttaagagtttcatattcatacttagtttctttgcatagagtgggtcttcctgtgctagaatataagttccacaagagcaaggaggttgtctgtgctgctctttgctctttcttccatgtctaaacggtaaatggcacatcgtagggtgagtaattgagtaaatgactaggcaaagctctcccatctcctgtagtacaactcacatttccttacaatgctaagttaagggactacaaagataaaatattacccaactactgcccacaggaattttaagttgtaggaaaaacacaaaacaaagcctgatttctcttttctagaatagaatagtttcctgtgtacaaaggacatgaataggatatgaattaggatggtgacaggtgaataatgtacataattcttggagttaggcactctttttttttttttcaatggaagaaaagagcagattcattgaaaggaaaatacattccacatagtgggagtgggctcaagcaagtgactcaacagcttttaggcatactcattactcagaaagtgaaatgttcatcttggacaaaactaaaggtttctacatttccttatgaaaagcttaaacaatcattttgagacagggtcttgctccatcacccagactggaatacagtggtgtggttatggctcactactgcctcgacctcccatgctcaagcatttctcccaccacagcctcttgagtagctgggactacaggtgcataccaccatgcccagctacttttagtattttgtttttttgtagagacagggcttcactatgtttcccaggctggtctcgaactcctggcctcaagcattcctccctcctctgtctcccattgtattgggattacaggcgtgagccattgcacccggccatgaattctttcttatgtaaataaataagacattaaaacagttgttaaattttgcctagtcagagtacgaagaaaacagtctccttatacactggcactagcatgtacatgagagaacaaacttaggctgttaaaacttttgtgagcaggagccatgggggccccacgacgaccggagaagcttcttccaaggcccccagggtcagccaagcagcacagatggggcaaaccctatgatgttcatctatctgctagaagttttccttaaaccatactgaaaagagcagctctccgtttcattcccaccgaggacttttaagaggggactgtattggcctatcttcatattgctatgaagaaatacctgagactaggtaatttataaaggaaagaggtttaatggacttacagttccacatggctggggaggcctcacagtcatggcaggaggtggaggacgaaaggcacgtcttacacagcggcaggcaagacagcgtgtgcagttttccattatcactgaaatctgccctttataaaaccatcagatctcatgagacttattcactatcacgagaacagcatgggaaaaacccgcccccatgattcaattatctctacctgatccctccacgacacgtggggattatggcaactcgaattcaagatgagatttgggtggggacacagccaaaccatatcagggacttcatcccaattgcagatggaatgtggaatgggagtgggagtggatgtcagcattttagggagtgcagctctgacatatgactgactccccaaatgtccactgggtcccaggtggtgttcgtcccatgtggactttactacatgaactctcaggctgaagggagttttgtttaaaaaaaaaaatgacagcaatggtgctgcctaagaggcctgtcacctgaggcctgatgatgaatgctgtgtcctctgcaattctatttcagccagcgaagtcccaaagggtgccttgagaattaaggtgaaagcagcaatgtctaagtgtaggattccaaagtgaagatctgcttgtttctctggcagacagccctgttttccttaatgcattaacaatgcttctcttattacattaattataagttgttaaaatgactcaaggatcacgttcttgttccccagcacccggagctttaattgagctttgatacacactcacgccatacaaagtgacaggcaggcgggcagggggcacagtggaggggagtacaaagatgaagacaggagggtatccccatgctggggctcccaattgatcaggaggatgtgtgtgttggacaacgtatttagatactaagatactgagaaggtgggattttaaaatttaagtttttccattatcactgaaaaaataccaagtaagctgctctttctggctaccaatggttaccactcattgcgcgcataatttgtgtcttacctaatttaattcttagaggcaaccagtgaagtgggttctattattgccctgtctcatggatgaggcaaccaagcatcagagatgttaaaagaagcatgtgccggttcatacagctggtaagtagataagctgggaaacagtttggagcctatttaaaatccatacacctggccactaagccccttctgatgaagcccttctggtctgattgacccttaggtacaggatgtgattagatcactctctgtgattagaagggccctcctatccctactacctcacatgctttgcttctgagagctgtgattttactattagagattcatttctttggggggaaatctagatctcttggtaaattacaagtgccccttcagatgactaacacattatgccttcatcatttataaactgctcactgtcatattgtaaagagggaccatggaaaggatggtccaggaggttggcatagtttagacagtggtcctcagaggagtcccttgtgaagcttgcagtttgggggtcctggtacatctggctgtagggcagcggagcatggacagaggagatgggccttcctcttctccacaatttggcttcagaccaccactgatatgtgacctcttcttgggcacctggctatgatacatgtccctgcctcccttggaacaggtgtggtcgcactgagttcaggctggtgaactatgagtagaggtgaaatgagtcaagaaagagaagtagggatccctaagtagccactgcatggaaaccccacccctcccccaccccaccctcatcatgaactatgatctgagtgaggagtagacttggtgcacaaagcctctgaattgtggggagtgtttattatggcagtagttaccctgctgcatggcctatgatttccccactgttctgcccccttgactcgccagctctctgccactgtcctcacaagccatgtgggaatagagaactgttcatttggagttggctacagcaaggtgtactgggctcgacagtgtcccctcaaaattcatgtccttcccagaatctccaaatgtgatcttctttggaatcagtgtttttgcagatgtaattagtgaacatgagattgtactggagtaggctgggcccataatccatggtgactggtgtccttataagacaggatgggacccagagacagaggaagaacatcatgtgatgatggggtgggtattggagcaatgcatctacgagccaaggaatgctgattgccggcaacactacaagctaagagaaagacaagggacagattgtcccctagagtcttcagagagaccacaatcctgctgacactttgacttcagacttctagcctctagaactgtgagagaataaagttctgttgtttaagccaccaaacttgtaacttcttatggcagctctgagaaatgaatatacaagggagtcagccaccatcgcttgcatttggcagagactcaaagactgccaggggtgtctttatcgagagaataagggaagacttcaggtgtgctctgattggaagttgtaggcaaggggcagctggggtcatgcccataagaagtggggtgttttatgtgattggtttgagagcatatttggctttttctcgttggtcttttttttttttttttgagatggagtttttgctcttgttgcccaggctggagtgcaatggcatgatctcggctcaccacagcctccaccacccagattcaagtgattctcctacctcagcctcctgagtagctgggattacaggcatgcacctccacccccggctaattttgtatttttagtagagatggggtttctccatgttggtcaggctgggtctcaaactcccagcctcaggtgatccgcccgcctcagcctcccaaagtgctgggattacaggcatgagccaccgcgcctggttctggttggtcttgagttggaagtggtggcaaaaaatagagaacttggcagtcattgaccgagtcctgactgcatagattgtggtttggtttcctgaagtggctgctgcagaggttcggtttggcttgccaaggcagttgctacaaagattatggctcaggattctgttgtcatgtatggtctcaccgctgcctgtttatatattccctttctctatcaaacgattcggggccaacatcctttgagaagacgtcacttatccccaccaatgcccccagtgcatttccgcatacgtcccttacccctcctggctcttctttacctgcctttcacaattttatgcattcttcccctttatcctccctttctccttcctcctcctccccttctttagagacagtatccttactaagtaaccattaatcaataaaaatgataatagctaactcttactgaatactctcaacgtgctagaaatgtacattgtccttttaatcatttcaacaaccctgtgagttagatattagtagctctgttttgcagatgaggaaaaactagctcggagtaattaggcaattttctaagaagtagaagagctaggatttcaatttaggagtcctttttttcaagttcatgcttttttactcttcacattaccttttaatcattttctttatataaaactaatagccttattataattattgtattactattgttaaatgtatttttcatttctgcaaaaccttttcaatgttcttattacaagaaagaaaggtagcatttttttcctgatataatgatgattaaaattggaagagctgcggcaaacggcatttcagaaggaacactatatatttaaacaagggttgtaatttcaaaaagctgatattatgtaacctcagagcagagagctgataaaaactaacttaatggcaagaattttattttgttattacagatttaaattttgattgactcagcaaaacagactattaggcagcattgaaaatcgatgtgaaaagggtttctgtgtaatatgcccactcatgaactcaagtttgacagaaagcaggtgcttcattggaatctaattatagagattggttcaatacaactccaaattgattacccataattcacattataaagactatagaatcatgcctatagtctgccctccaaagaacatagtcatctattttcaaaatctctccagtgacctctagccccccaatttttttttttactctgcagaatttaaaattacgtgtgattgcctttggctagaagaatctattaaacacatttgtccattattacaacaaaaattactgcacacctgttacaggcaaagcactgcattaggcaacatgggagctacaaaataaatcatacaccagaactcacagccttggagaaaagatcaggtatacatctaagtacctaggcaatgatttctgttctttatgagatgtcctcaaattatttgatacccttcctgtagaacggtgagggtccacttctccttcccttgaaagctggcatgtgacagctttgggaagtaaagtaaggcagaaatgatgctatgtcagctccaggctgcctttaaaaggattagcagcttccattttggtctattggagcctggagctaccatgtacaaatgcccactaccctgaggataccatgctatgtggaagtacatgctaggcatgtggagaagctctggaaagagaatgggcaagagggatgcccaggtccactcagctgaggctccagaaatcatggagcaacgataaaccagccctgttttgtcctgacctaagttttgactcagaattatgaaatataaaaatgattagttatagttttaggctactacgtgttggtgtaatttgttctaacagataaccaaatgtgcttagtgtcaacaaaaatggacagatgagggccctgagaaattagaagaaaaatgtatttctagcctttaaggtggtgggagaaaacagggaaagtttcaaagcagtggtgacatttgagttgagcgtggaaaactttaggatttggaaatgcagacaggaaaggataaggatgctccaggcaaagaaaataatgttgacaaaaatacagaagtgagaaagtgtctgatgcatttggagtgttactgagcactgggctcgctgggtgatgcacacagaagccaagacttatggcactgacttttgagataagtaaaagctttattgagaattgacgagcaaggagacagaaggcaatgctcaaatgtgtcttctctgtatggggtggggggcgggggggggccaagcttttaaagcatttctaagtagtcccaggtgatgccaatgcagctgatctgccaggctggtggtgttaacaattagttttcattgcatgtgcctgagtgacatgactttcagttttggctctgtgccatctgtaacagcttaagcaacgttaattggtttgagctggtcacttggttacaagtggttcactttgacaaaagaaaatagtttgcaagagtgaattgtgatgatatgagtgaaaggaaggctgaaagtatcaccaaaggcccaaaagccttgaaggccagagtgaggagttacattcaattacgtggatgaggaatagccaccccatattttgaacaaagaagtgatattgttaatcttgtgttttggaggaagttaatacacttccacgggaattaaggaaggaaggagtccagttatgacagctgagtagttagttggagagctgggggcccaaactgtttcctctttggggtagaggcagagtcctggagggactgggttgatatgcagaatagtggcccccagagatgcccacgtcctagtccctggaacccatgggcatgtaatggcaaaagggactttgcagatgtgatcaaggttaaggctattgagattagaagtttatcctgaattacccagaggggccaaatttaatcacgtgtccttaaaagggagaaaccttggaagctgtggtcagaggaaggtaggcctctggaagaaaagtgggagagatgcagaatgacaaggacttgacctgccattcctagctttgaagatagaaaatggggctaaaagccaaggaatgcaaccatccctagaagctggcaaggactctcagtttacagccagaaaaaaaaaaaatttaaaacaaaactaggacctcagttttacaactgtgaagaactgaagtttgctaacaacccaaatgagcaaaggatcctctcccagaacctccagaaagaatatagccccaccaataccttattgtagcccagtgagacccatgtccaacatctgaactccagaactgtagaataataaatatgtgttgtttagccactacatccgtggtaatttgttacagcaacaggaaacaagtacagacctcaattagctaatgacattcattggacaccactgcactagaaaccaggagctgaccggcctctcttgagctgcagctccttttgggctatggttctattttcaggctacataggaacattggctttttgtccctgtgtgttcttgatgcagccaggtgaccttgattaacttacctaagctcattgagcttcagtttcatcatctgttcaatgaggaggttgagcaaaaacagctccaaactttactttttctcaccatgacatgcttgatagaaaatgttcccatcttccactcactgacgggcataatctaggtttggggaaatttccagcactctagaaataacattatttcctctccccatcaaaaaatcaggccgggtgcagtggctcacacctgtagtctcagcactttgggaagcttgggtgggtggatcgcttgagccccggagtccgagccagcttgggcaacatgggaagaccttgtctctaccaaaaacaaacaaacaaaatagccgggcatgatgacatgtgcttatagtcccagctactcgggaggctgaggtaggaggatcacttgagcccaggaggtcaaggatgcagtgaaccatgaatgtgccactacactccagcctgagcaacagagtaagaccctgtctcaaaaaaagaaagaaaaaaaggaaaaaagtattctcatttgagctggctgcagtggcatgcaccacagccccagctactcggaagactgaggtgggaggatcacttgagcccaggaggtcaaggttgcagtgagctgtgaacgtgccactgcactccagcctgggcaacagagtgagaccctgtctcaaaaaaaaaaaaaaaaaaatcacgtcagaatataagtgataagcgatgttttgacagggataaccttatatttactctaatttattgagcttagttgcagaatttggatatttatgtatatatatcataatattttacaaaagtggcacagaattacattaatgtaatgcacaacaagaaatctatcatcggctgggcatggtagctcacacctgttatcctagcactttgagaggctgaagtgggaggatcatttgagctcaggagtttgagaccagcctgggtaacagaaggagacctcatctccaaaaaaaaaaaaaaaaaattagccgagtgtgtggtggcacacgcctgtggtcccagctacttagaaagctaagatgggaggatggcttgagcccaggagactgaggcagcagtgaaccatgattgtaccactgcactccaccctgctgacagagtgagaccctgtctcaaaaacagaaaacaaaacaaacaaaaaaactcaacaacaacaaaacattgtatatcataagcaatgaagttttactattaataccacaatactaacagtagatgtgagcactgagctagacattggtaatactcttcctagcgctgaaatggaatagttttaggaattgaagagtggcctaaattagttgagggggaaccacttgcagctgaaagtgtggaagaaggtgaagggggaaaaaacattttctaaaaccttaaaaaaaaaaatcagttcctccccctgagtctccacccctaaccaaactgagcaaacccttaatacagcaatagtattagacttgtaattatttcattaggaaatgacacacaaaacttcatcctgaatttgtgcagggagctagggccaagggccttctagtaattcctaatgagcttcctattgaataagaaagaactaaaacagggtagcaaggaaaccaatcaatatcgacagcaggcctgcctgagctgcagtctatttagtggccctggagctgtttcatgttgagcatctgtgccaggaatagttctaaatcttaatatttcaatattttcaaggcagttcaatttgagttaggtgcccagacacaaagcacatgaatttcttgaaaaagggatgacacggtgttgggaaaggagtcctttacatggtgtggctaagacctgggccctgggggtcagacatcccagtgtatgaatcccagttctatcactaactgtgagtatgacattaggcaagttacttcacctctcttgacctcagtagccttttctgtaaagtgaagagaatcgtaatgccttcttcatgtactgagggcttagacagatgcctggtgggaagtgaggactcagtgtcagctctcaccattattaagaccacagttacctcaaggaaaagcctgccgagcgggctggactgctttcttgtcatgcattatattaatgaagttccttgcctgctttgtaaaatatatgggcatttatgcataaaatttcaagtcctttatctaagctgttatgcactttttgaaatcttccatagtgtggctttcatggcattcccttctttagatgctaatctttttttttttttttttttttttgagacagtcttgctctgttccccagtctagagtgcagtggtgcgatctcggctcactgcagcctccgcctcctgggttcaagcgattcttgtgccttggcctcccaggtagctgggattacaagtgcggcaccaccacacccggctactttttttttagtatttttagtagagacggggtttccctagtagagacggggtttccccatgttgttcaggctggtcccgaactcctggcctgaagtgatccagccgccttggcctcccaaagtgctgggattacaggcatgagccaccgcgcccggcctagatgctgatctttttaatgtatgaattgaactagacttttgttgggaccaggattatacttctgttctcctggcccagttctcagagcaagggatgcatcagttactggaaatctgaaatccagttagaagaccttccttcccactccatagtgacttgcaggagagaatgaggaacacagataaacaaaccagaagaggtgcttttgtttttgtgcaaatgacactgttagttctgaacagatgactggaccatgaaattattagaatagcacagcaggtccctggtaagagtgactcaaagtggttgccttgctttttgttaacaccagtgaaatttgaattacacagatgagaatatgcattggaatggggagtcaagggtaatggattctaattcgtcttttaccagaaatagttatgtgaccctgagcaagtcacttgccctttctggctttaaatttgtcctccataaaatgaagaagttgaattagatcaatgcatctcattctgggacatgcaaaacatgagtgctgtgtgacattattcaggtaattttgctatgtacttactttaacatgcacttaaagaatatacgaggtagctgggcatggtgcctcaacgcctgtaatcccagcactttgggaggccaaggtgagactctgtctcaacaaaaaaataggaaaatgtactaagtatatcagccccatgatttcatggatcttattgcttaaaatgaaactcaacgtatttaagtttagaaagaagaagcaaaaacagatgaaaacattttgtattagacactggtctgatctcctgatatatatatcccggctgatgacgttgtctggtgtgtattaatcatgttttttattttgcacattttatggcgctttgatatctggaggcctttctattccaggaagggactgcttctctcaagattagctaattcctagagatagcaaacaactgctttagagcatgcctttcatatgcaaaccaaccaatcctgtgtccatacctcctacccaccttctttcattaggctcctgcagtttgggacactagcctcctgccctaaatcacactgggccaggtacaggacaattagagaccaccccctatagttttgagctcactgaaattattcaaactattcagttctaaatgtgactaccctgccttgcccatttcttcctgtaaaaaccataataaaggctctggcccaagcatttgcttccctccttctccctcctgattgtccctggtgcttctcgacctggccctgcatgacataccctgcccctcctcttgagaactgtgaataacaaactgtcttttcaatggcagccagtctcctgatctgatggcctcaccatagctggattttaaaatggggaaagaatacctttgagctactcttattaattgtgaagaacttttacctcatcacctggcaggcttgctttttctctgttttaaaaattgtcttgttatagaaagtagattagttgccaggggctaggaggaggagagaatggggagtgactcctaatgctatgggattctttttggggtgatgaatgctggttgtggaatgagatagtgatgatggttgcacaattttgtaaatatactaaaaacactgagctgtacactttaaaagggtgatgtttatggtatgtgagttatattttaagaaaaaatggtcctcttgaccacttttcctctcctctaactcatttgccctgcaaaattcaacttcgatgtcatcttgtcccccaaagcctttgcatgcaatgcctatggttataatacttctccttgctgtgttttcagggttttgtttttgtttttatagagacagggtctttctctatcacctaggctgcagtgcagtagtatgatcatagctcactgcagccttgaactccaggactcagtaactcagtactcaagtagctgggactgcaggtgcgcaccaccatgcccggctaattttttttttttttttttttttgagacagggtctcactttgccaccaaggctggagtgcagtggtgcaatctgggctcacttcagcctcaacctcccaggttcaagcgatcttcgcacctcagccccgctagtagctgggactacagggatgcatcaccacacccggctaatttttgtatgttttgtagagatggggtttcaccacattgcccgggctggtcttgaactcctgacctcaagtgatccaccagcctcagcctcccaaagtgctaagattacaggcgtgagccactgtgcctggccccgactgattttttaaaatttttatttttggctgggtgcggtggctcacacctgtaatcccagcactttgggaggccgaggcgggcggatcacaaggccagaagatagagaccatcctggctaacacggtgaaaccccatctctactaaaaatacaaaaaattatttgggtgtggttgtgggcacctgtagtcaccactgcactccagcttgggcgatagagcgagactccttctcaaaaaaaaaaaaaaaagaaagaaagaaaaaaatttatttttgtagaaatgaggtctcaccacctggcccaggctggtcttgaactcctgggctcaaggtatcctcccacctcagctgcccagagggctgggattacaagcatgagccactccaccagcctccttgctatgttttccttgctggtttatgaggggtgggcgttaagaaaaagaaacactttctcgtagacccttccgttgttgcttgggaaagttgccatttaactccaacccaccaccacgaccctaccccaccacttctttgatccaagaagttcctagcaaatctcagtttctatttcagtcaaacagaatctcaaatgtgtgattttccggtgtgacttttcccacgctttttcctggggcttctaaatcaaaaaatgagagagggaacttgtgttttccatttggaggcactgcttttcaaagatttggggacagatgagttagcagtcaagcaaggtccaagtcttatacattctagtaattcatactggaaaagatgactttttctcaggaaaagcctatgactttgggaagagctccaatccacaaatgcccatcagaagggccacactgcattgaagcagtttcagcagatgttgactctaaaagattaactgcaagctttgatagctggttttgtcagcttgtaattggctcctgggaaagggaaaaccaaatccttctatgtatctatccatatcttttctgtgctaattgtttgctttttcttgaaagagtacagcaaacccgctcatgacagagcctcctgattaaatgctgatgaaccgtaatagtgcctctcagataagacaggactctccctagctgcctttgctcccataaaggaagccacaagccaaagcacgagctccttgaagaacgttaggggaatgaagggagggttgtttagtactcgaattgtgggaatggtgggtgtagtttaaggaggtaaagcagtaggccagagcattcacaacctctccacctaccacactagagagattctagggtttcgccagctggaatgtgcacacaaaaatcacctgggcatcttgttaaaatgcaggttctagttcagtaaggtggagtctgaaattctgcatttctaacaaacttccaagtgatgttggtgctgctgatcctcagaccacattttgagtagcaagaaatatctctgatttcctacatatcttttgttcttccttttttctttttttgagacaggttctcactctgtcacgaaggctggagtgcagtggtgcaatcacagctcactgcaactttgatctcctgggcccaagggatcctcctgcttcatcctcccaagtagctgggaccacagagatgcgctgccgctcctggctaatttttaaaattttgttttagagatgggggtctccctatgttgcccaggctcatcttgaactcctgggcttcagcgatcctcccacctcggcccccaaaatgctaggattacagacgtgagctatgtatctttaaaatctaaattgaaggccgggcgcggtggctcacgcctgtaatcccaacactttgggaggcccaggtgggcggatcatgagatcaggagattgaggccatcctggctaacatagtgaaaccctgtctctactaaaaatacaaaaaaattagccgggcgtggtggaggacgcctgtaatcccagctattggggaggctgaggcaggagaatcgcttgaacccgggaggcagaggttgcagtgagctgagatcatggcactgccctccagcctgggcaataagagcgagactccacctcaaaaaaaaaaaaaatctagattgaaaagaactttctgaaagttgacaattgggggttctttcttgcctgtctcagttaaatattaatgacagcaataataattaaagtaacaacaatgactgatatttatggaaggcatagtatgtacagggctagcctagcttaactataactgttacccgcctatgaaaggactacctgtggtctagagacagtaaataacttcgctaagttctcattgtcagtagtaagtggcagagcaggaactcaaagactatttgactccacaagtgcgctctaaatattactgtctctcatctccctttgtcttattttaggttcagtgaggctgaacttatgaagtgtgatctttgctttcaaaatggagcatttttgtgtgctacaggactaagccagtggtgcaaagttatccatgaagtcagatggtaggtgtggacagacaatgcatgatacacaggcaaaaactcaatggagaaactcaatgacctgcagacttagtctgcactgatagcaaaacgctttccccaatgatttatttttcccttgcaaagcagacactagattaggaagagagtgttgtcaccataatatgaggcttatcaaaaattggtggaaaggtaagaaaactgtatctattatatatttttaaggcaaaattatgttgtcttccttgaacataaattaaaaagcttagacaggacaccaaaagcacagaaaaaagcacataaaagaaaaaaaaggatgaattggactttatcaaaattaaaaattaatacacttcaaatgacattgtaaagtgaaaagatgacccacacagtgaaagaaaatatttgcaaattatctgtctgataaaggggttgtgtccttacaactcaatattaacccaattaaataatcaccaggccgggcacggtggctcatgcctgtaatccgagcactttgggaggccaaggcgggaggatcacaaggtcaggagatcgagaccatcctggctaacatggtgaaaccccatctctactaaaaaatacaaaaaattagctgggcctggtggcaggcgcctgtagtcccagctacttgggaggctgaggcaggaggatggcatgaacccggggggcagagcttgcagtgagccgagatcgtgccactgcactccagcctgggtgacagagcaagactatgtctcaaaaataaataaataaatgaccaaaagatctgaatagatatttcaccaaagaaaatataccgatgagcaataagcagttgaaaaggtggtaatatcattagactttaggaaaatgtaaattaaagtcaccataagatgctacttcatgctcactagagtggctgtaataaaaaagacacaataacaagtgctgacaaggatgtggggaaactggaacacccatgcattgcctgtggaaatgtgaaatagctcagttactttggaaaattccagtcatataaaggattttgtttcctcgatctagtttccttgcatattggaatgccttttttgtggtatgtttcacatgttgtttttttgtgacctaaaattttttttacatcaaaaatatcttaaatcctttaaaagatgaagtagctaaacttagacctttttgtttttgtttttgttgtaacttcttttaatcaaatttatcgcaagcagcagtttatacccagagcggtggataattaaatttaaaattcagctttatttaaataatttgatttaaaattttgataggtgtcagttttaatttatattttgccttttaaatttaagagataatttaaaacattttagaatagaaaccatttaaaatattttaatattttatatttacttacatacatatattaaatagaatgcatgcatatttacgtgtgtttgtgtttgttgatttcccttctccttcttccccacactatttttatatagggtgtgttattgtggttaagtttacagttgagtccacagggcttataatgttgagatgggatccaaaagaattagaaaaatggtcctcatgcagaaatcccagacttcaggttggatacaggaaccaaagaaattttgtgttgccttcttctgggaagtggatgagatcgagatgagatttcatggcaaaatgttaactggaaactttaaaaaaatatatacctatggaaaggtatgttgagcagccaaaggaacgaactgtatttatttagcagctaactcttgttctaatttgggaggagtcaccgattgcatgtgctccctctcttattacaaaagtcagagggagatgataggttgttactcttcattctgcctggacgccagggtgggagcacatgaacccgagctctgctacttctgtgcagggctttgaattctgattgagtgacacagaggaatattatcacggttcactccggaccgcagcctgtttttgtcttaggaccttggtcatagtactgctccccctgcctggagctttttgccccaaatctcctgtggcagctctgttacttctttcaggtctcggctccaacgtcactcccctggccatctaaaacagccacctcttctcatcattctctgttctctaactgggctttatttttccatatggcacatatacagaattatatatttattttacattgcttttttttggtactacaatgtactgtattctcgtcaagaatacaaacactgttttgttcaccacttcatctccggggtgagaacagtgcctagcacaagtaagtgctcaatacatttttgtgaaaagtgaatcaataaatgaaagctagcccagtgcttggcaggccaataaatacctgtgaaacagaactgtattagtattagttctatatcaggctcacttgggcagaaattgaatctggtgagtgacacaaagatgaacacataatagagtttacttccagcagcaatttgtttcttttgttaagttatgaagcatgaaaacttggcctaatttaaaatggcaactgcttgcaggccctgacacagtatctgccaacttccactcaaatacttaatgagaactaagaaaaatatagaaaccagccctgacagacaatcagatgtagagcatcagaagaattttcactaagtcaaatggtgcagtattaggaaagcaacttgcagttctcatgaaacagtgaagcctgttccctcaaaagaaattaaaacacactttctttgctagtaagtgacactagttaaaagacaagaaacaaaatatagcatgttggttacaaaatgcacccctaccccccaaggaaattaaaaagaaaagattagacttaaaagaatgagtaagatttttctggcaaatgcaaatgaaaagaacacagaggtgggaaaattattctctgacagtgtagaatctgaggcaaaaaaagcattaatgagacaaaagaggaaattttatactgatataagttaaaattcacaccaaaggtagaatagtcagtaatgtacatgcattgtttatcaaagagccagaaaaaaaggaagaatggataaaaggtaattgtgagagcttctgaaacatttttcatttacttttacaaatctggtagttaaaaaatacacgtagaggagaaaatctgaacaataaattaagatttaatagtatatttgtatccagaaactatatcctcttcttgggcacccattaatttttataaaaattgactataggttagcatagtgagaaaataacttccccaaatgaaaatacagatcaaatgtcctgaagatagtgcaataaaattagaagtgaataacaaaagtgtaagaaagaaattttaggccaggcgcagtggctcatgcctgtagtcccagcagtttaggaggccaaggtgggagaactgcttgagctcaggagtgagaccagcctgagcaacatagtgaaactctagctctaaattaaacaaacaagcaaaaaaaaaaccagccacattttgtggtgtgtgcctgtaatcccagctacttgggaggctgaggcgggaggattgtttgagtgcaagaggtcaaagctgcagtgagctatgaccacaccactgcattctagccttcgtgacagagtgagaccctggctcaaaagaaagaaagaaagagagagacagagagagagaggcagacagaaaggaaggaaggaaggaaggaaggaaggaaggaaggaaggaaggaaggaaggaaggaaggaaggaaggaaggaattttagaaataaataaaaataggtccaagtgtgatggggctcataacagtaatcccagcactttgggaggacaagtcagtggatcgcttgagcttaggagtttgagaccagcctggggaacatggtgaaaccctgtctctaccaaaaatacaaaaaattagccagtcttgggtccgcctgtggtcctagctacttgagaggctgaggtgggaggatcgcttcagccagggaagtggaggttgcaatgagccgagatcacatcactgcactccacctgggtgacagagtgagacctcatctcaaaacaaacaaacaaacaaacaaattttccccaaaaatactgagtcaaaagagaaataaaaagtatgatttctgatgatttagaaatcaatgtaaaaagaatattttcagaaaaccagcaaaaccaaactctgagcaaaatcattggcttaaggaagtacaaaaataaatgaagtgaatgttcaacacagaacttatcaaagtgataaaacataggcattgaaaatagaaggaaaaataatattgagcaaatgttagtggatttgaaaagaagaacaatttaattgataaataattagataagttttaaaagaaaaatagtaaaatagacaaatcgtgagatttgtctgggtaaaatttttacccagaaaaagagggaaaacagaataaaagaaatttcaaatgaaaaacagcaatgaaaaacagatgtcctctgtctattaatacgtttgaggatttgaaagacatggatgatattttgtgagaacataaaactaccaaataatcatggatgaaaattgaactatttgttaaaaaattatctctaaagtagatttaaggccaagccaatgaggtctcagaccatcacaaaataaataattcctatcttgactacataaactttttcagagtaagataagttcagacattatcaaacaaaatttaacgttatgttataataatcatttttgataaccaagtacagattatattagtatttcaaagaagttttatacatgtgatacttcagaaggtttaatataaaaattaatgtttaataaatgtagaaaagccacctaatattatcaagttcatatctaataaaaatttcttagaaaaaatatggagaatagtctatttcctcagtgtgcgaagaacatttatcccatatcagcagcaaacaatgttaaatagcaaaacgtattcccattaaaattagatttacgattgttctggatgctctggccaatgccaataatatatgaaataaaaatatgagaaatagtattggaaagaatgagaagaagttcttactaacctataagataggttagtaaattcctgggatatgatgtaaataaaaattggtagcattttgaataccagcaataactagctagaaaatacagtggataaagtagatttcattccaaataaaagtaacaacgataaaaaatgaactacaatcaatttcaataagaaatgtatgtctcatatatattataaaactaaaaaagagcctttgaaattatttatgatgcaatgttatttttaaatggcaggacataaatatatattacaagtttaatgttatattacatgtcatatatatgcttagaaaaatatggaaaggaaatataagtaaatgtcaacagcagtaaaataataggtaagagttttgcagtcagcagaacagggttgaatcctctccacctcttgcagagacccactgagggttaaggcttcaacctgtgaattttggggaaatacaattgagtccacaacagatgcatttgtggaggaaggagaaatctgaaatttacattgatgtctttcagagtgcgcacaggtatgttaatatcattcattcatggcagtaacaataaatatccttaatattttgcagcttataaagccagctgacatatttttctcaaatcacggaaatgccacctcatcactgaggtcttctctgaatagcaccccatgtatcatgtggcattatgtgtatataatactgtccccagccattgttctcttacctagctttacttttcatttatcatcttatcatcatccaatatatttgttttttcagctttattaagacataaatgacaaaaatggcatatattcaagtatacaatgtgatgatttgatatacatatacattgtgggatgattagtccaattaagtgaatgaacacattcatcaccatgcaagttaccatcttttgtgtgtttgtgtgtgatgaggatacttaagatgtgctctcccagcaaatttcaagtaaataatacagtattattaaacattattattaactacagtaagcaagctatacattagaccctcagaacttattcatcttataactgaaagtttgaactctttggccaacatctccccattttcatcccctttcagcccctgacaatcacagttctattctccacttccgagtttgactttttttttttttttttaaagagacagtgtctcattctgtcacccaggctggagtgcagcggcattttcatagcccactgtaaccttgatcttctgggcccaagtgatcctcctgccttagtcccctgagtagctaggactacaggcatgcaccaccatggccagctaattaaaaaaaaaaaaaaagtagagatggagtcttgctatgttacccaggctgatcttgaactcttggcctcaagcaatccttcctccttggcctcccaaagtgctggggttacagacatgatccactgtgcccggcctatgagcctgactttctaaagattccacataaaagtgcgatcatacagtatttgtctttctgtgtcttatttcacttaacataatgtcctccaagttaatctacagtgttgcaaatggcagggtttccttttttaaggctgagtaatattccattgtgtatatataccacatttttattatccattcatctttcagtggatgcttagattttttctgtatcttggctactataaataatgctgcaataaacacaaaggtgcaggtgtctctttgatatattgatttcatttcctttgattatatacccagtagtgaaattgctggatcatatggtagttctgtttttaatattttgaggaacttcatactgttttccataatggctgtatcaatttacattcccatcaacagtgtacagagttctcttttctccacgcctttgccaatacttatttcttatttttgtttgacaacagtcaccctaacaggtatgatgtgatatttcattgtggttttgatttgcctttccctgattattagtgatgttgaacatttttttttcatatatctattagtccatttgtatgtcttccttggaaaagtacctattcagttgcccactgtttaaatgggtggtttttttttttttttttttttttttgctattgagttgtgtaagttcctggatatattttggatattaaccccttatctgatatgtggtttgcaaatattatcgctcactttgtaggctgcctcttcattttgttgattgattgctttgctgtgtagaagcttttgggtttcatgtagtcccacttgtttattttttcttttgttgcctgtgcttttggtgtcatacccaaaaaaatcattgcaagtattggtttagttattttttgcccattgctgatactaggaaagacttcctgagagcataatatacatttgttttgttcactattgtgtccacatcccagcacccagaacaatgcctggtgcacagtaggtgaccaatacatttttacttgaaagattaagttattatgtgatcatcccaagtaactgtgtggttaagtaggtagtgtaggtactgtttatagataagggacaagtagctcatattgtgtctggaattggtgggtttttggtctcactgacttcaagaaagaagccgcagaccctcgcggtgagtgttacagttcttaaaggcggcgtgtccggagtttgctctttctgatgtttggatgtgtttggagttttattccttctggtgggttcgtggtctcgctcgctcaggagtgaagctgcagaccttcgcggtgagtgttaaagctcataaaggcagtgcggaccgaaaaagcaagatttattgcaaagagcaaaagaacaaagcttccacagtgtggaaagggacctgagcaggttaccagggctgcctgggacagcctgcttttattcccttgtctggccacacccacatcctgctgactggtccattttacagagagctgattggtctgttttgacagggcgctgattggtgtgtttacaatccctgaggtagacacacaagttctccaagtccccactagattagctagacacagagcactgattgctgcattcacaaaccctgagctagacacaaggtgctgattggtgcatttacaaaccttgagctagacacagagtgctgattggtgcattcacaatcccttagctagacataaaggttctccaagtccccactagattagctagacacagagcactgattggtgcacttacaaaccttgagctagatacattgtgctgattggtacatttacaaaccttgagctagacacagagtgccaattggtgtatttacaatcccttagctggacataaaggttctacaagtccccactagactcaggagaccagctggcttcacctagtggatcacgcaccagggctgcaggtggagctgcccgccagttccgagccgtgagcctgcactcctcagcccttgggcggtggatgggaccaggcgccgcagagcagggggcggcgctccttggggaggcgctccttggggaggctcgggccacacaggagcccacagcgggggaaggctcaggcatggcgggctgcaggtcctgagccccgccccgcagggaggcagctgaggccaggcgagaattcgagcacagtgccgttgggcaagtactgctgggggacccggcgcaccctccgcagctgctggcctgggtgctaagcccctcactgcctggccggtgttgccggctgccgctccgagtgcggagcccgtggagcccatgcccacccggaactcgcactggccggcaagcgccgtgcgcatcccgggttcccacccatgcctctccctccacacctccccacaagccgagggagccggctctggcctcagccagctcagagaggggctcccacggtgcagtggcaggctgaaggtcccctcaagcgctgccagagtgggcgcggaggaggtgcccacagcgagcgagggctgcgcgtgctgccagcacactgtcacctctcaatgtggtcacaaggattctgatttcctgtctcataggctttctattaccagtacattctgttatcagtcttcatgactcatgatcttgtcttagattattagataaatatatgggttctttttgaaaagctttgttgagatataattcatgtatcatataattcacccacttaaagaaaacaatcaaatggtttgtagtatattcacagagttgtgcaatcattattacatgatttttataacaatatcatcacctccaaaagaattgccctatcctttaggcagcacccccccaattcctccatcactcccagccccaggtgactattaatctgtctgaagtccttatagatttgccttatagctcactgaaacctcgagcccttgggctcaagccaccctcctgcctcagcctcctgagcagctaggactacaggtgtgcaccaccaagactggctacttactaaaaatttttttatagagatggagtctcgctatattgcccaggctggtcttgaactctggtcgcatgcaatcctcccattttaagtatatatacagcttctatacattgcttgttagaattatttctagatggtttaggtttttgttattattttgaatgaattgagtgttctagagctgtgctgtccaatgtagtagctgcttgacatatgcagctattgagcacatgaaatatggttggtcctgtttctttttaaagtcgctactagcacatttaaaatgacgtacgtgacaaattatatttctgtggaatggtcatgttcctgacagaacaaatttatcagatgaatataaaaatatgtatttcattttgtattttgtagccaaaatactacaagctctcaaggaaaactgagatttgctgtgagggtaaaatacacaccagaatttttttttttttttttttttttttgagacggagtcttgctctgttacccaggctggagtgcggtggtgcaatctcggctcaatgcagcctctgtcccctgggttccagcaattctcctattctcctggctcagcctcttgggtagctgggattacaggtgcacgccaccacgcccggctaatttttgtgtttttagtagagatggggtttcgccatgttggccaggctggtcttgaactcctgacctcaggtgatcccccccaccttggtctcccaaagtgctgggattgcaggcttgagccactgcgcccggcctacacgccggaattttaaagctcggtatgaaaaaaagaatgtaaatatttcattactaattttaagtgttaattacatattgaagtgatactactttgggtcatatatttaagtaatatttaacgataaaatatgttattaaaattaatttcacctgtatcttttaacttgtttaatgtcacgaatagaacatttaaagttgcatatgtgacttgtggtatattaatattggatagtgatggtctagacataaaatttatcaggtaagtttaaaatgtgtattccactttgtattttgtagccaaaatcttaaaatccctcagaaagaaacatattttgaaaggtagtagaggaagatcccatgatcagaaaagactgaagatataccatgaaaatagtgtttggctctatatccaaatatatcacaaatttgatgactaggcatgggctgcccacatctatcccagtctgggccttcacaatagcctctcaatgggatgtccctcttctgttcttgccctctccctgggaataatccccacaccagtcagagggctgtttccatgatgctggtcaggttccaccacttcctgcctcagcacccgtcaatggcttcccaaagccttacgtgatctgggcttcctctcccatctctctttccagtctaggcttcgcccatcagctctggctacaccatcacctctccttgttccctttctcttgggatactctcctggcctggtcttgtcagggctggctcctacctgtcattcatatctcagcttcctttgcagtgggttttcagagcgtctcatgaagagtaaagactatgaagctatcctgcctgagtagctgtgtgactctgggagagtttacttttcttttctttttttcttgttttttttgtttgtttgtttgttttttgagatggactgtcactctgtcgcccaggctggagtgcagcggcacgatcttggctcactgcaagctccaactcctgggttcgtgccattcttctgcctcagcctcctgagtagctgggactacaggtgcccgccaccacgcccagctaattttttgtatttttagtagaaatggggtttcaccgtgttaaccagaatggttttaatctcctgacctcgtgatccgcccgcctaggcctcccaaagtgctgggattacaggcgtgagccaccgtgcccagcgggagagtttacttttctattccagtctgctcatctgcaaaagggtataattatggcgtcctcagaagattaaatgagtgattacatgaacaatgcttacaacagtgtctggcatatagtaagtaccatgtttatatcatcatcatcactaccaccaccatcatcattgtcactattaaatgtttggcaatcccagcactttgggaggctgaggcaggtggattgcttgagctcaggaattcaaaaccagcctgggtaacatcgtaaaaccccatctctactaaaaatacaaaaaaatagccaggttggtggcatgtgactgttgtccaagccactcgggaggctgaggtgggaggttgaggctgcagtgagtcctcattgcgccaccatacttgagcctgggcaacagagtgagaccttatctcaaaacaaaacaaaacaaaaaacttggcaacatgtatcaaggaacttaagaaagggtctcaccactgatccaacaattcagttgaaggaatttatcccaagtaaatgtttacttagacaagagtatatggatttgcatacctcatgggatttaaaaaattattttaaaacaattacaattatctattataaaataattacaataatatattttaaaataggaatgataaattggaaatagcctacgtattgattaaataccaacaacagtgaaataacagacagtcatgaaaaattacctagattggaaattcttaacgttttcttgttccatggacccctttggcaatctggataaatgtaatcaatatcttctcagaataatgtttttaatggtgtaaaactgaatacataggaatgtgaagaaaacagatacatggaaataaaataatcagaatactaaattttttttgtaatgtattaataaatgtgattttttttttttttttgagacaggatctgactggagtgcagtggtgcaatcacggctcactacagcctcaacctcccaggctcaagccatcctcccacctcagcgtcccgagtagctggaattacaggcgcacatcaccacacctggctaatttttgtatttttggtagagatgaggtttcaccatattgcccaggctggtcttgaactcctggtatcaagtgatcctcctgcacttttggcctcccaaagtgttgggattacggtcgcgcgccatggtgcccagctgattcttctttttaaaggcataacataaaaagatctagtaataggtctaataattatatttttcaagtagtggtaaacataaatacatcaagatacctgtgacaaactctccgtggtatattaatacttatggtttttagtggagacaaattcacaggtgctgctaacacaactgtgatttattgtctataccaagaatttgaaagatatgttaaattgcagctagaattgataaaaataaagatgtagtctccccgccaacccaaattcataaaccctcaggtttaaaatccgtgatctcgcttataggtccccaggctttttctataaagggccacataataaaaatttagacttatgggccatatggtctcagtcacaactactgagttccctgtttgtaatgtgaaagcagtcacagacaacatgcaaaaaaatgagcatggtcgtgttctgataaaactttatttactaaagaaggcagagggcctgatttggcttgtggagtatactttactgttcccagtctagaataaaagtttctaacttggaaaaatgttcccaaactgctaaatgaaacagagcaggttgcaaataattatgaagtgttcccttttggtggaaaaagtatatctctatgtatgtcccgtgcatatgaacagatgtataaaaatacacaagtttggaagggcttactaaaatgtcaatggtgattgtttctgggtgatgggaatatgaacactctatacttttctatattctctcattgtttttcaatcagggtacattaattttatagttagaaaagtaagaattagttgagcacagtggctcccgcctgtaatcccagcactttgggaggctgaggagggcggatcgcttgagatcaagagatccagaccagcctgggtgacacggcgaaaccccatttctactaaaaatattaatacaaaaaaaatagctgggtgtggtggtgcatacctgtggtcccagctacttgggaggctgaggtgggaggatcacttgagcccgggaggcagaggttgcagtgagccaagatcgtgccactgcactgcagcctgggtgacgaagtgaggccctgtttcaattaaaaaaaaaaaaaggaaagaaaaataagaattaaaacaaataaactggaggggcttttaaaggtccaaactcatacgaaccttgaatccctcttgaatccctccaaccttcttcctaagtcctcggtgagaaaaaactcacctgtatcctttcactatactgatattctgttttatgcagttaaaacattattctaatatgggatccagcagacttctccaggctaccaaaggggtctgtggaacaagaaaaagtgaatgtagtatctgcccgctccctggtcataaccctccaggagtcaaatgacgcaagccttagtctttcactgtagtgctctcagaattaaaagcaaaattcatatgaagaatccagcaaaggatgggtaactggagatcctcagtaagtgttcattctgttctcctttccttctgtaggctggtgccaccaacatttggaattagctatcagttctcttatctgaaatcgtattgcttccagaatgggtacctctagttgttttaccaattcgtcacttgcatcagacagagccaagtgtcaccctctgtgttcctctcaagccctctgctttattccttgctggcaggaccctaatgatgtcaggtattaattttgctatgtgttttgggaaggttatccttccccatctccagggaggattaagtgctgattagtataaattagtggttttcaactggggccattctgccctatcagggatactagacaatatcggagacttttttattatcactttttattatcaaaagggttgccactggcatctagtggatagaggccagggatgcttcatataatgcataaggcactccccacaataaagaataaccttgtccaaaatgtcaatagtaccatgttttagacaccttcacctaaccaatcatggtaattccatttctttttccaggtggtgaaactgtggccagtgagctcaagagaaatcctgggaggaaaaaaacccttttatccctgatataaaaaatgcatgaggagaaactgcccttccttacggcctttcgatattcctggggaaaaatgtgatggttgcagctgcagtaggtttttgtcattaatacaaaagatggcagagacaagacaggaaaaacaccgacctcctcagtgacattgctgagtctgggaaacaatcctgcaacctccttactgctctggacttcttattggtaaaatagtttgggtttttttttctttttacattgagacagggtcttgttctgtctcccaggctggggtgcagtggcgtgatctcagctcactgcaacctctgccttctgggctcagatgatcctcccctctcggcctcctgagtagctgggaccacaggcatgtgccatcatgcccagctaacttttgtattttttttgtagcaacaggattttcccatgttacccgggctggtcttggattcctgggcccaagtgatccacccaccatggcttcccaaagtgctgggatcacaggagtgagctgctgtgcctggcctaaaacagtttcttttaaaaatttactattgtcccggcgtggtggctcatacctgtaatcccagcactttgggaggctgaggtgggtgaatcacgaggtcaggagtttgagaccagcctggccaacacagtgaaaccccatctctactaaaaatacaaaaaattagctgtgtgtagtggtgggcacctgtaatcccagctacttgagaggctgaggcaggagaatcacttgaacctgggagatgaaggttgcagtgagctgagatcatgccactgcagtccagcctgggtgacagagtgagactttgtctcagaaacaaaataaataaataataaataaataaataaataaataaataaaataaaaatgtaaaaaaatgctatttgttctttttgtgttatatgtagccttttaaaaatgttaatgctagagtttatacagggtccctcccccattccatggttgtagaaattgagacctaaatggtttaggggacttgcttatggtcacacagctttttaagcaatgcagatgggaccagaaagtcagctgatacgattgagcccttagtgtatttacaatattgtgcctgtgcctggggaagttcccagaaaattaagtatgagtaaattcagaggctctttggataaagatcttacactggatcaacaataatgacaatgagctgagcacctactatgtgacagccactttatatatatttatcttgaatcttcacaatcaccctgagtggttggtattatttttctcattttgtaggcaatgaaaattgaaacatggagtttcaatggctcacccaaggctacacagcaagatgttcatgaaatcaaacctatgtcagatcttagaatccactctaattccactataccacatgacctcccttcctaagcatcaaagcctactagactcatgacagcgcaagctccaaagtgggtgcatctgaaggaagattttgtcttaatatattttacccagtggatgatgcttcttaacagtgacttcaagagcaaactaaagagtaatactgaggaagagagttcagataaaacacccatcacctacagttaaagagcagtgaggtttgggtagggttgaggggtacggcatacagatgaagatcttgcttcaagatcggactccctggggagctactcagttcttctcctcgttgtactgccaacctctggcaagccagccatcaacactgtgatattaagagcacaatagtgatcatttcttatgtggttgccagtcagtactgtgctgttcttcctaataaggatgaataaactaactaacttagcatacatcgtttcctttagtcctctcaaaacctagggagggatttaccttaaaagcgacccaacaaaccaactgtgttgccctttgcccaaggcaacacagccagcaactgtaaggagactcagttcccactatacctctgagcctctgtcttgtgcgtctccccctcagacctgcctatttctcattccttgtctttgctgcagctgagcccctgtttggaatgctatcgccctccccctcttcccggtcatgtgtcacagctcaggtgaaatcctgcatccttgggggaaatgtgtctgtgaccactttagtccacagagcttttcccttactgatacctcaaaaaaagaaaaaaattcgctgaactttattatgaacatcttgttgcacctatcttgatttatttcagttgatacttaacataaaaaaagcacacatacgatttaaaaatatttctccaaatagccctctgcgttaggaaatagaaaaccgccacttactagttatgccactttgttcaatcactcttgaaacctcaatttcctcagcccctaaatgggcataatcttactaggcctcggagaacctgcagggttcttgtgaggacagaacattttcctacaggaaaatgtttaaaaaatgtaattccctagaccaggaactagaaagccaaatgcccacaagaatcaagcagcgaatgagggaaggaggccagggtaagacaacaggaattagtgggggtctggtgccctggagaccacatgtcccatctgaggagacagctgttgctcagctccagccaattactgccattcaggaatgaggacccagtgttgcgagagcttaatttttcaagagacacaaaaaaacaaagacttaaagtgacatcatttgatttttgtaacatcgctgggtgcggtgtttcatgcctgttatcccagcactttgggatgccaaggcaggtggatcgcttcagcccaggagtttgagaccagcctgagcaaagccccatctctacaaatatagaaaaattagtcaggcatggtgtcatgcgcctatagttccagctacttggggagggggcaggggcgggtgctgcagtggatgcatagcttgagcctgggaggttgaagcttcagtgaactgattgctccgccgcactccagcctgggtgacggagtaagacctactctcaaaaaaaaccaaaccaaaacaaaaaacaaacaaaaccccccattatttatgccaaactaaacgaaacataatgagtgtctttcctataggaagctactttgcaactttgttctatatatgtgtatattgctctagacaagaatatttggattggctctctgagttattttgtgtaaaatgttttcttcaatatatacttagtaagtctaagtttcgctttctcaataagactgtaagggtttttggacacaatttatacctcctgtattgatgtgtaagccaagcctgattaacaatcttggtaaatggtaacttacttgtttgtctatttgtgtggtccttaaatgtcagcatgagtcagcatttcctgagttgcttgttaaaaatgatgatttcccccagcaattccatccctagaaatagaacagtgtacatttattcatcaaaagacatgtactaggatgatcatagcagcactattcacaatagctgcaaactgaaatctatccaattgcccattagcagtcttagaataaatttaaaaattgcattacattcacaatgaaaaatctatgcagcactgaaaaagaataaactgtaactgcaggcagcaacatagatgaatttcacaaatacaaggtcaagcaaaataagtcagacaccaaagggtgtacaatatatatttccatttctataaatacagaaattggtaaaacctaatgcatgggttataaattagaataatagtaactgttggggtcgggcgcggtggctcacgcctgtaatcccagcactttggaaggccaaggtgggcggatcatgaggtcaggagattgagaccatcctggccaacatggtgaaatcctgtctctactaaaaatacaaaaattagctgggtatggtagcacgcacctgtaatcccagttactcgggaggctgaggcaggagaatcgcttgaaccgggaggtagaggctgcagtgagtggagatcgcgccgtgccactgcactccagcctgggtgacagagtgagactccgtctcaaaaaaaaaaaaaaacaaaactacaaaaacaaacaaaaaaagcaaaacagtaactgttggagagaagtagtgataaagggaaaaaaagagacttctagggtgctggcagtgttctttcttgatctgggttctggttgcatgggtgtgaaaattaattgaggtgtctactttttgtacttttctgtacattaatattgcaatgaaatgttaaaatgctaattccagggccctagcccagactgatagaatcaccctctcttgagtgcaggtgtgtgggtgtgtctgtgcatgtgtgtggtcaacagggtccccaggcatttctatgcacatcattagggtaacatcctttgaaaattacaccgcacttgaatgacacacatatttccttcttcaaggggtttctgcaagcactcttggctaactcagcagcatctgcctttcctagtttcttttgttgtatatgcccatgttttaccagaagccaagagggacataacgttaagaggtcttatgggtactttcaaacagtggcacttggggcaacagagagagacagctctgataatgtgccagcttataaaatatagctaaatataattaaatgtttatggggtgactaatacgccatatccctaggggaataagtcaagtgctcaccgttgctgaatttccactgaatcctggcttctctagagaaggattgctgggtggaagccagaaggagctggggcttttccttctgcccatatgcccaatacatgcccagtttagtgttcagggctcactgtgctcaatagatatgtttgttgctgtcttttccatctggaagggactgtaaagatcatctggttcagaggctgtcacagatctacctagagaggtgcagcagcatctgctgagatgtggtaaatatacagattcccaggccaacagcaaacccgctgagtcttaattccattgctttggagcttcatttcaatgaataacaatttaaagtgagtgtatcaatagagcagaataggctgggcacagtggctcatgcctataattccagcactttaagaggctgagatgggtggatcacttgaggtcaggagttagagaccagcctggccaacatggtgaaacccaacctttactaaaaatacagaaaaaaaaaaattagctgggtgtggaggtataattctagctacttgggaggctgaggcaggtgaatcacttgaacccgggaggcagaggttgcagtgagtcgagattgtgccaccatattccaggctgggccacagtgcaaaactccatttcattaaaaaaaaaaaaaaaaaaaaaaaagagcgagtagcagagtcgaaggcagctctgatacaataactgagcaagttgcttcactgtctttgagcctcactttcctcatctgtgaagtgagaataatactatctaccatggagggttgtgaggagggtgcttacaaagccctgccagctctacctggaacatccccagcattccatcgatgttggctactaagaaaggtacttcagattacattgttgttactggaattaactcacaataaaaaaagaaaattcagcaatgtttggtggctcatgcctgtaatcccagtgctttgggaggctaagcagggaggacttcttgaggctagaagtttgagaccagcccaggcaacatggcaagaccccatctctacaaaaaaaaaaaaaaaagaataaaaaattagctgggtatggtggcacacacctgtagttccagctacttgggaggctgaggtggggagatcacttgagcccaggaggtcgaggctgcagtgagccctgattgtgccactgcacttcagcctgggtgacagagcaagatctcatctctaaaaagaaaaagaaaaaaaaagaaaagaaaactcatctgtatcactataattatttttttcacctttaaaaatctgaaatgtagtaaaaggaacttcttactgaaaaggttatctaggtaccatccaaagtcctcctgcatgctccacttttcggggccacatggataatatatttggagaaacaatgaaaagagcacaggccgatggaaaggaatggtttcaagatcgcacttcttgctaacatttttgtcaagactaggggaagtgtgcagcctgttgcctgagattgagagtgggtagatggggaaaagggttgatttcttccaggaagggtgaaaatagacatgttggtgccaagctcttgaacattacacaagacaggacacctcattgcgcattggactacttttgcctagggagacctggacgttaaagtggttgtcaagctgtccggtgtggagtctacaaaaaagaacagatccgcagtttaagatttatgctccaggacggtaggatcaccactccgaatacacaactcacgtaggttcttggctgactccctttgggtctctgttgctttttccctgccttcttgggtttaaatattactcaggtatttatgaaaagggagcataaaatttggctgaggaccagtgcagttcagtgcaatccacttgcacgaagccctgaaatgtgctggaacactgattttattactaaataactgaataggaatggaagagaaccagacagaatttgattctagaggctgggtatggtggcttacagctgtaatctcaacactttgtaatctctactaaaaatataaaaattagtcaggaatggttgtgcatgcctgtaatcccagctactcaggaggctgaggcaggagaatcacttaaaactgggaggcagaggttgcagtgagccaagatcctgacactgcactgcagcctgggcgacagagtaagactccgtctcaaaaaaaaaaaaaaaaaagaatttgattctataaaagaaggctgcattttaaggatgaggaaatgtagtgacatgaagtaactcacctgggtcccactggatatttagcttcagaaatcaactcaaatccccaaatgcctcatgtcaaagctgcatacagatgttcagacaacagatgaggttttaaagacaaagaggaagacggcagtctctgaggaagacttctctacccagtgaatatgtggacactgagagcttcatggtatctttcctggtattggtttgacaaagttaagaactaatgtgaagcagaggcatacaggatgctagaccgaccatctggatccacacataaccatgtgaagaaatcatgaataccggaagactggaggcatgtttcttacaaaattagctcctctaccagtgacacacctacagtgggcctgctggcatcatgccactgttgttctgggaaaaatgagttcaagccacctggttatgtccctaaacaatggtggaatttggtaagaatggataaagggagtattgctagttcattcccctatcactagctcacataaaatgcccactcagctattgctatcacctctgaaggatggtcaggtgttcgggtaagatttagatattaaaattgtttggccaggcatggtggctcatgcctgtaatcctagcactttaggaagccaaggcaggagaatcacttgaggtcatgagttcaagaccagcctggtcaacatggcaagaccctatttctacaaaaagatttttaaaaaattgttcagcagacacttggcattctcagatgtaatacttagtaataacaatgacaattataatatgaacatagtgcttaatatgtgtgagacgctgtgttaagcatttttcatgtgacaactcattgacctgtgacgacaccatttgtgttagtcccttgtcatgctgttgataaagacataactgagactgggaagaaaaagaagtttaactggacttacagttccacattcttaggctggggaggcctcagaatcatggcagaaggtgaaaggcacttcttacaagtcgacagcaagagaaaatgaggaggaagcaaaaacagaaacctctgacaaacccatcagatctcgtgagacttattcactatcacaagaacagcacgggaaagactggcccccatgattcaattacctccctctgggtccctcccacaacacgtgggaattctgggagatacaattcaagttaagatttgaatggggacacagccaagccatatcattctgccccggcccctccaaatctcatgtcctcacatttcaaaaccaatcatgccttcctaacagtcccccaaagtcttaactcatttcagcattaacccaaaagtccacagtacaaagtctcatctgagatgaggcaagtccctcctgcctatgagcctgtaaagtcaaaagcaagctagttacttcctagatacaatgggagtacaggtactgggaaatacagccatttcaaatgagagaatttggccaaaacaaaggaattacagggcccatgcaagtccgaaatccaatggggcagtcaaattttaaagctccaaagtgatcttctttgactccaggtctcacacccaggtcacactgatactagaggagggttcccataattgtgggcagctctgcccctgtggctttgcagggtacagccttcctcctggctgctttcacgggctggcattgagtgtctgtggcttttccaggctcacagtgcaggctgtcggtggatctaccattctggggtctggaggacagaggccctcctctcacagctccactaggcagtggcctagtagggactctgtgtgggggctcccaccctacatttgccttctgcactgccctagcagaggttctccatgagggccctgcccctgcagcaaacttttgcctgggcatccaggcatttccatacatcttctgaaatctaggtggaggttcccaaacctcagttcttgacttctgtgcacctgcaggctcaacatctcgtggaagctaacaaggcctggggcttgtactctctgaagccacagcctgagcctagggctagtgccctaggctgcacaggctgcacacagcacggggaccctgggcccagcctacgaaaccactttttcctcctgggcctccaggcctgtgatgggaggggctgccatgaaggtctctgacatggcctggagacatttggtcttgtggtcttgtggattaacattaggcttcttgctactcatgcaaatttctgcagctggcttgaatttctccccagaaaatgggttttcttttccactacatcgtcaggctgcaaattttctgaacttctatgcttagcttccctttttaaatgtagtgcttttaacagcacccaagtcacatttcgaatgctttgttgcttagaaatttcttccaccagataaccgaaatcatctctctcaagttcaaagttccacaaatctctggggcaggagcaaaatcccgccagtttctttgctaaaacataacaagagtcacctttgctcctgttcccaacaagtttctcatctccatctgagaccacctcagcctggactttattgttcatatcactatcaacatttttgtcaaagccatcaacaagtatcttggaggttccaaactttcccacattttcctgtcttcttctgagccctccaaactgttccaacctctgcccgttacacagttccaaagtcgcttccacatttttgggtatcttttcagcaacaccccactctactggtaccaatttgctgtattagttcgttttcatgctgctgataaagacatacctgagactgggaagaaaaagaggtttaattggatttacagttccacatggctggggaagcctcagaattataggggaaggccaaaggcacttcttacatgacagcagcaagagaaaatgaggaggaagcaaaagcggcaacccctgataaacccatcagatcccatcagatagtgagacttattcactatcatgagaatagcaagggaaagactggccctcatgattcaattacgtccctctgggtctctcccacatgtgggaattctgggagacacattcaagttgaaggccggtgtggtggctcatgcctgtaatcccagcacttcgggagaccaaggtaggcaaatcacctgaggtcaggacttcaagaccagcctgaccaacaggatgaaaccctgtctctacttaaaaaaaaaaaaaaaaaaaaaaaaattcagccccgtgtggtgtcgggtgcctgtaatgacagcaacttgggaggctgagggaggagaattgcttgaacccgggaggtgaaggttgcagtgagctgagaccttgctattgcactccagcctgggtgacaaaagtgaaactcaatctcaaaaaaaaaaaaaaaaaaaaattagttgagatttgaatggagacacagccaaaccatatcaccattattatctccattttatagataaagaaactgaagcagagcagtaaattcacccaggatcacataactgtgaggtgtcatagcttggatttaaactaggacaggatggcttcacaactttcagtcttcatgagtcactctgaagacccatatatagtaatttgtcattcttcagaagcagggattgaattcacttgttatgaaagggctttgtgcaagaagaaagtcacttagctagtgactgagcccagcccattgaacaacatctgaatctcagaaaagtttttctgttttctggtcaacctaatgtggaccttttgcaagaaaattatatgccacagtagatggcatataatttagttagatgtaataattatgatgcttttgacaataggtaacaaaaatgccaactaacaagcattttaaaagtaaagacaattaactttctaatgcaacaagaagtctggagagaggtggttttaggttggtgcagcagctcaaagatcctcagcatgttggtgttgacttccctcgtgtcccaaggtggctgcagtagttccaagcatcacatcttcattctctggtatccaagaagaaaagagggagggaaggcaaaaacatttcctctttttaaggaggaaaaatactttctggaagttccccctacctcttttctgtcacatttcattgcccagaactatgttacatgtcaacccctaagctgaggtttctccacctcagccttattgacgttttggcccaggtgattatttgttgtgtgaggcttagcagcatccctggcctccactcattagatgcggggaatacagtcccagttaggacaaccaaaaatgtttccagacactgtcaaatgtgtgtgtgtgtgtctgtaaaattgcctgaggttgagaactattgtcttagaccaatgactggcaaaaagaaatgggaaagtcataactgacttagacgaatcagtttatcctctggggctgggcacactgatgcctgaagagtcctgtttaagggaggaggggtaatggctgtggttttacaatcatgcccacattgctttgtgtttttgttttttgtctctttaaaatagagaaatagggtcttggctatgttgacaattgtctatgttgccaatagagtcttgtatatgtggcccaggctggtcttgaactcctgggctcaagcgatcctcccaccttggcctcccaaagtgttggggttcccggtgtgagccactgggcctggcctccatgttgctttgttgttcaaacaaatgcttttattggaaatccaaggggagaattgaaaaggaggtgttctgtcttctcatgtccaagaaatcattcctgtggtacgctgggaagcattaggtcttagaaataggtgtctcaagataacgaatttttcagctttggtggccacaggaaaacaacagggagtcagggtagccaatcttctttttatttagaaaatctacaccaagatgccttttttggggcatttttttttctccacctccctttttttttttttaaagacaaacttgtatttgtccgtggatacttggtaaataaggactgcaaaaggaaaattcctaaatgtattcctccattacatgccttggacatttaacttcagaaattaagattatggttgtaaaacttttcaaattggttgtttgaaaaccattggtaaacaccattaggttggctgcccaaggtcatttcagtcttatgatatttattttcaaaatttcaatcagtcaggaggtatacaaggtgggattcagaactttcagctagaaaacaatacttggatttaaagggttacaaggtgtgatttttctggctttcaaagagctgtgtttcagatcatggttttcatcaaagtcattttctacatttttgtaaacatgtttaataagaaaaaatttaaatagccaaaacaaaatgaaaaattgctctaaatatggaaacattggaatgagtgctatgttgtaaaggctctcccttatgaaaacactataaagctagcactgtatatcttagggaagggggacattttgttattgctttctaaaagaacttttttactctatcctttagcagtgagattgaaagaatattgagaattccctgatgggaacccagctttcattattaaaaggaaggccctgagtaaatatgaaattacttacattagggctacagacaccaatgaaggctgaacgcccaattataataaatgaaaattgttagttgaatttccccccaaaaccacagaggcataaatacttcaggaattgattttcttttactcagataccttataatgattcagcaaaacaaaattataaatacttcagctctgagtaatattaaattgggagcagattggatcctactccccacagtccacttacctcagacaggtcggcagtaccaggatgtgcttcagtggaaaagtttatcctaaattgattggagcagaaaaaacaaaatctgatatatgtatttttaaactcccacccctcatcatgtgctcagtgcattttttccccctcatcgcaattttgtaaaggtctgattcaaaatatttaattagaaaattagcttaatcagatttgagggaactaaaaatagaacaaccctaaggtgagtgtatatatacatacacacacacacatatatacaggttctctgttgtcagatagcaattaagaaaaagattaccactaagaaaaaaatatatatctattttatgtacacatatacccacacatacttgtagtcaattatattattcatggtagctatgttctttaaagttgtaacaaatactgaattagtaaatagcaaatcattgaccctaggggaaacttagggttaagttcctgcaaacctgtggtcacaacatgattattcactgatcaacacataaccttgttttatgtatgtttttgtttaaagacaccttatttaatacacagtgctgattcatttttaacattgaactcacaaacaccataactcacatctgcacaaaatttatctaacacacgtattttctctgtaaggcacatcacagccttcttacgcttaggaacacaagagaactatggttgggggctgttttaaacagcaaaatcaccaactaaaagcacacaaatgtgaaaaacctggtgctagatagacctcgaaaaggacccctgtttataggctgaggggtgaaacaagtattcgacctgggaacatgcacattaggtgactcaaatttcccccctctttccgcaggtctgaataatcacagaagtgctacagtattgattttgggggttacaaacatgtatatatacacatacatatgtacatacacacacatatgtacatatatacacacacacacatatatcttgtttgttggtgcaaaaaattggttctctgttcactacacgtatgtgaaaggaagtattctctctaccaggccttcctataagaccctcaagctgggagtaggtaaagttttttagtaagtgaatggctttgaggctgtggaagataaaaagatggatcaactgcctaagatatggggtccttagagagtggcaaatagaaatccccaccctgcccatttctcaggcacatctaacgctccccagtcacagagctacgtactagatgtgtaaacttgggccaagcaggtaactgctttgtacctcagtttcctcaagtataaaatgggataaattttagaacatactgtcatggggccagcattgcatgggcgataagaataatttatttaccaagacagtcgcagttaaagaaaggcagattagagaaagtatgaaaatatgttgcaaggaagcaatgggcaggtcagcaaaagaagagccgactgcaaagagacaaaggcttgctagggcttttataggatgttgtgctatgtgctgaagagggctctgtgcagtactgataatgccaaggttgcagtgagctaacttgcatttttctttcagccaagggtctggtgatagctgggctcaggaagattgtgagtcatttgtgcaggaggggctatgtgtcttggaccatgaagaaagatagacttatagtttatctgctttctctttttgctttccctcgtttctggcagtccaactccctgtccctaattaggactccacacgtatctctttgagttgctgtgaggattaaatgagataatgcttgtaacaatgaaaaagcacaagtcttttcttggtacgaccagaccttagataactcctgacgagatgcaatatgtgaaacatacaacccaagtatgacatattattgtcaaaaacagtgaagcctaatcaagcctccggagccaaccaggagggagagttaactagtcaaacagtttcatgctttgcaaacaatcagataaattcaggaggtaagacagctgactttgtgtgtgtatgcgtgtgtgtgtgggggtgtgtgtgtgtgtgtgtgtgtgtggcaacaagttaatagcatgaaaaaaagaaagggaagggggaactttcatgagatgaaagagaaataatcatcaagtgcaatatgtgcacaattaagttgtacaaagacacctttgggacagttggggacatttgaatataactggctagctggtattaaataattaaaataattacctctattgttaatagaggtaatagagaatggtactgcagttttataggaaaatgtccttatactttagaggtttatacagaagtgttaaagggtaaatgacatgttgccagggatttaaaaaaaatattatgggaagggaaagaaaaaaaagggaaagattaggaaaaaacactgctaattagttgcttgactaaagttagtagtaaattatttctttttctttgtttttgtttttgtttttgtttttgtttttttctgagatggggtctggctctgtcgcctagactgggatgcagtaatgtgatcatagcccactgcagcctcaaactcctgggcttaagtgatactcctgcctcagcctcctgaatagctggaactatagatgcacgccatcatgcctggctaatttttaaaatttttggtagagatgggggtctcactatgttgcccaggctggtaatgaactcctgacattgagtgaagctcccatctcaggctcccaaaagtgctgtgattacaggtgtgagacattgcacccagtcaacagtaaattcttttgaagtggttagaagtctgctgcctacagtacttttggagttatggaagggtttagctcaattctatgtagttgttattacttaaagagtgaacttttggcagggcgcagtggctcacgcctgtaatctcagcactttgggaggccgaggcaggcggatcacgaggtcaagagttcgagaccagcctgaccaacttggtgaaaccccgtctctgctaaaaatacaaaaattagccgggcgtgctggcgtgcgcctgtaatcccagctactcaggaggctgaggcagaagaatcacttgaacccgggaagcagaggttgcaccgagctgagatcgcgcctctgcactccagcctgggcgacagagtgagacttcatctcaaaaaaaaaaaaaaaaaaaaaaaaaagagagtgaacttttagttgcagtgagagagaagagagaaacataagaaatggttgctaagtaatagcttagtcagcagaggtctggaatctctggggtctctgagatctttcatgtgattcatgagttccaaaactgtttttataagaatgctaaggagctgaagctgagacctaaaagctaagcaggagtgctctgggcagagggaatggtacgtgcaaaggctctacagagcactctgcatatggaagtctgactcaaagtgcttctgtgtaattggaatgtacagttcacagcacatacatagctgatggagcggtttgtgggaggattcctttgccttacatttgttcattggcatgggactgaagccttggcattgagtgccacacttcttgcagtgaggtaggaacctgtcaaagcttggaaggccatcttaaaggtatccaattctgaacattttctctcttgttttctgtatacttaagaatactacctttggccaggtgcggtgactcacacctgtaatcccagcactttgggaggctgaggcaggcagatcacgaggtcaggagaccgaggccatcctgacgaacacagtgaaaccccgtctctactaaaaatacaaaaaattagccaggagtggtggagggcgcctgtagtcctagctactcgggaggctgaggcaggagaatggattgaacccgggaagtggagcttgcagtgagccgagactgcgccactgcactccagcctgggcaacagagcgagactccttctcgaaaaaaaaaaatgctactcttaaagatacccaggtttggcaaagtaattgtaatcaccccagtccatcctatagggcacttgtgagtttataaagctcttccttatgggcatttctgcatttggattttgagccaatagggtagacacagtgggcattattatccccaatttacagagtgggaaaataaggctctaaaacatcaagtttcttgacctgtgttacccagttaatgagtagccaagccaggacttgaagcttggtctttagccaccaaatcattaataaactaatcaattcattaaaatgctcattgattccatatgattccgtcataggtgatggctgaggatgcaagatgaatgagacaagtccttactctcacatacttgtcccctgtgtttctccacatgtctctccagtcccctgtgtctctccagtgtctattcttcctgatgctctcccttcccccaacccccgacaggccccagtgtgttgcttccctccctgtctccatgtgttctcatcattcagatcccacttacaagtgagaacatgtggtgtttggttttctgttcctgtgttagtttgctgaaaataatggcttccagctccatccatgtccctgcaaaggacatgatctcattcctttaaatggctgcatagtattctatggtgtatatttaccacattttcttagtccattatgttattgatgaacatttgggttaatttcatctctttgctattgtgaatagtgctgtaacgaacatacgcatgcatgtatctttatattagaatgatacatattcctttgggtatatgcccaataatgggattgctcggtcacatggtatttctgtctcttggtatttgaggaattgccacaatgtcttccacatggttgaactaatgtacacttccaccaacagtataaaagccttcctttttctctgcaacctcgccagcatctgttgtttcctgactttttaataattgccattctgactgtgagatggtatctcattgtggttttgatttgcatttctctaatgatcagtgatgctcagctttttttcatgtttgttggctgcgtgaatgccttcttctgagcagtgtccattcgtgtcctttgcccactctttttttttcttcttgtaaatttgtttaagttctttgtaaactctggatactagacctttgtcagatggatagattgcaaatattttctcccattctgtaggctgcctattcactctgatgatagtttcttttgctgagcagaagctctttagtttaattagattccatttatcaatatttgcttttgtcgctattgcttttggcatttttgtcttgaaatctttgcctgtgcctatgttctgaatgttattgcctagattttcttctagggtttttatagttttgacgtttacgtttaagttcttactttctaaggcagaagtggcaacatggtaacctataggccaaatctggccctcaggttaaatcaggctcacggacacagtattggggccttccccttgctggttattctctgtgttttaaatttgaattaatcaccaatgtttcccttgagggagagttgtacatagggatctggattctgacctctcttaaacaatggaaagatctggcaatacgagtactgactcaagtgcactccagtttgccacagtccccatggtcttctcttgtccctgggatagtgcattaattcacagcatctgcctggtctgggccaggcctaaaggatcaaagactgcttctttagtgctacatccatggccctccatgatttggcctcaacttgcctcttttgcttcatctccatcccatttggaactttatgctctggtaataaggagatgattgtagttcccagaatagagtatgtctgtggttcctttaaatgacctgtacctttttctcagttctactgaaccatatgttccttcaagacccagattagatatcatcttctccaggaggccttccctgacccttgaggatctctttgtgttcccctagtttcttgtgccctctctaactatgatactgaaatgatctgcttatccagtagcccccccattgggaacttctctcacctgcctacattcacttttgtagcccagcacctagtgcagtgtcaggcatacctaggggcaggtgtcataagaactcagactccaaatgcttccattagagaaggcctgggaatccagagaggggaattttattggagaccaaatccctttctgcagccttttgccttcttttctctatgtgtccgttccaggagcccctgtgcatgaaaaaaaatttactaatttggttttactgggcacattgggctttagataggagatagtttaaataatcaagtctttctggcttcttgcctttgcacgcctggatgagccagaagtgaaaatgtaggtgagtcactgagttgcctctcggccccactgcagtgcaaggcttaggagacccctcctcaagaatggtgctcctggcaatttgggagagggaactgattctgagaagccagcctaggctaggatggcttaatcactataattactcattgcagctattaataatcgctagttatttagatatgaagtaattaattcaccactattaaatagaggtacttagtgaggaattaaatactttgcctaaagctatccttagaagaaaggcagggaggccaggtagtatggtggcttctgcctgtaacctcagcactttgggaggccaaggcaggaagatttcttgaggccaggagttcaagaccagcccaggcaatatagtgagacactgcctctaccaaataataataataataataataataataatggggaacatggtaatctaatttagagcctgctctattccaaaccaactccaggaaactcacctcgatgacaggatctggttgaggatgttattccttacattgcagaatgtcctcctgctcctctgtatcaggaaaagccatgttgttcctggacagtgtgagttagatagcctgtcctgattccctttctgtgttaattgctggaaagctcagagtcaaatttgtgacttgcttatttaggtttgtatggtgttcacttttggaataagcctcattcttagctttctacttgtatttttctttcttttggcctacctacttaaaaaaaataaacgtccctaccctgcctttactaaagaatgatactttgtgcaaacgaaatctttaaaaatgtatagaacacagaaaagcaaacacaaaatgagtaaaaatcacctagtcatacccagagagaacaccatttatattttggtatattttctccctacccccacctaacccacagtctatacatatattttaggttggtgcaaaggtaattgcggttatcgccatactttttttttttcttatgagacagagtcttgctctgtcacccagactggagtgcactagtgtcatcttggcccactgaaaactctgccccccagattcaagtgattctcctgcctcagcctcctaagtagctggaattacagttgtgcaccaccatgcctggctaatttttgtatttttagtagagacggggtttcaccaagttggcagggctggtctgaacccctgacctcaagtgatccacctgcctcggcctcccaaaatgctgggattacaggcgtgagccactgtgccttgcctattattgccattacttttagtggcaaaaaccacaattacctttgcaccaacctaatacaaaatgagattatatcatatatagtgttttataactgtccttcccttcaccccacttactacaccatgcacatctttctatgtgattaggtgtcttctgtcttgtagatgttccataatatattcaatcaatataagattgttgaatgttaggctgtttctaaatgtttccttttataaaacaaccaaaaaaatgtaataaacactcgtatcaaaatcttcatgcatagattgatcttttggtgacaattcttagacgttttcattgccttttaacttatgttgcttcatttaatgtatcctgtcaagcacccttaaatactttctggaacaagctgagataggactaatctgttgctcagcatcaccacccatcaattacctgggaaaaattttctcggaagactcaagatacaaagaatgataagaggtgatctctgtgtcctcccggggtttaaattcgactaggcgaaaacagatgacctataaaaatgtgcactaagtgaccaaatacaaggttagagaaaagtttatatataaggtggcatctgaaagctgccagaggcaacaattcataaggacaggttggtacattcagcaaatatttaccgtaccaagtgttttgtgcaccccgtgctgaggatacaatggagattaagacccagtctttgtccctaaggagctcaaggtccatagggggtgaatgagtgaaggggagggtctcagagtacttacacagattattgcaaaacaacctggcaagtgttcttagagacacacaggattttctggaagcttgaagtctggaagaggggggccaaaaaaggcttcctggagttgagcctaaaggatgaagagaaagccaaacaaaagagcaaaaagaccttttgcagagagcagtagacaaactttttgactttgccccacagtgagaaattcattttaaatcttgatctagtataggtacatttttgtacataagtgaaacaaaagtttcatgaattgattgtctaatacgtgcaaaataattttactttctattttaattcattaaaaaatagtatggtcgcaatctactaaattgttttgatgacccattcatgagtacttacgtgctgattgaacattataagcctaaactgaggatgggtttagtgcttgacaaagcgagagttaaatccaagtagtggctaaaagtctctggagtagaacagccaggtcaggaaaaggtccttgaaaagcccctcttacttgcaaaatgaagcataaacatgctccaattgtcataataaaaagaatgaagaacacctttttgttcttttgagtggtttaccaaaagctccctcaccctttgttatgtagagctggtacctggggagagctggtacctctgtttgtggaaattgcctcaaatctctttcccccaacattctgagtctttcagaatggcgagacagggtgacgaagtacctaagataaaattaccctgaggacagccttactaacgattaggttcaactcaaagggctgagaattcacaagggtgggctggtttgggcgcagtgtgcgtatgatggtctgaacttccaggttcagatgtgctttggtaagaaatggctgagtacgtgcttaccaaagcacagtggatgagaaatgtgcttaccaaagcacagtggatgtgctttggtaagaaatggctgagtatgagagtgtaaacggggaaaaaaagctgtaacgctaaaggccataatgagacttcaatgagcttcagctggtgcccggatcagtgaggacaactcagtaaccaacgctccatccacaagcagtggtgcggagccagtcttcagcagcgcccccggtgttagtgggaagcaatagcagtagtaactgatgagcgcagtttctctggcctggggaagaggtgtggtaaaatccttatggactcagtaagactctaggagggttcttggtcagttttgtgtgtggggagaggtcttaaaggaatgatacagaacatcctgccattaaagcacagactagtttaaaacgtgtaatcagatttgaagtctgagtttgtagagcaggtatgtatgccagcaccatgtggaatttagcctaggttcatcgaatggagcccatattcttaagcatgccaccagtggtttttcaagtgtggtttcctgaccagaagcatcagcatctcccaggaacttgttagaaacgcacattctcagacttccttcaagacctgctgaatcagaaactctgagagtggggccctgcaagctggtttcacaagccccccagatgaggaaactgaggcttggagaaggtcccacagctagccagcaataacctggattcaaattcaggcaccagctcccagggcccatgctctaaaccactagcacagcgtttctcaaacttttttggactaagcctcagagttggaaatgcaaattattcttattttaattttaatttttagttctggggtacatgtgcaggatgtgcaggtttgttacataggcaaacgtgtgccatggtggtttgctgcaccaatcaacccatcacctgggtattaagcctggcatgcattagctggaaatgtaaattatctcatggcccaggacacacatataaaagtgttaggaaacaatatacattttttttcctattctattttcttctatgctcttctatttcagctaaaaaaagtttttagctatggctcaccaaattggtttcacatcccactaatgactgggttataacccatagtttgaaaacccctgcatgagaacatactattttacaccaaaaaagccaaccagtgtgaaatagcaagaatgtaagacatgggagatgtcatttaagtatgttattgttaggtacaggtgacaagtattacggtcaaacatttgagagagagaaaaagagatattgaaataggggaggtaagagaactgaggcttccatggagaggcaggatacagagttctaagccttgagaatgaaatagaattcagagggaaaaaatcagggaaggacactctaacaatccctaggccttaagggattaaagtgggaactactaaatgtcagtattatcatctgtaaaatggggtaataattgtccctatctaaagggtttactgtgagggtagaagaaaataatgcatgttggccggacccagtggctcacgcctgtaatcccagacttttgggaggccaaggcaaaaggatcacttgaggccacgagtttgagatcaacctggccaatatagtgaaaccccgtctctacaaaaatataaaaattagccaggcgtggtggcacgtgcctgtaattccagctacttgggaggctgaagaaggaaaattgcttgcgcctgggaggcggaggttgcagtgagccgagattgcaccactgtactccaggctaggagacagagaaagactctgctcaggaaaagaaaaagaaaaagaaaaaagaaaccaataatgcatgtgccatgctttgcacttagtcactgttcacgggcaaaatgatgagaaccacataagtaagcatttctggtagtcatattaaaaaagaaaagagtaaacggatgaaattaattttaataatataggcccggtgcggtggctcacgcctgtaatcccagcaccttgggaggccgaggcgggcagatcacaaggtcaggagattgagaccatcctggctaacacggtgaaaccccgtctctactaaaattacaaaaaaattagccgggcgtggtggcgggcgcctatagtctcagctactcgggaggctgaggcaggagaatggcatgaactcgggaggtggagcttgtagtgagccaagattgtaccactgcattccatcctgggcaacagagtgagactctgtctcaaaaaaatataataataataatatatattacctaacccaacatattcaaaatattattttgacacgcaatccataaaaaaattattaagatattgcatgtatctttttcatagtgtatctgtggaatccagtgtatattttacacttgtaacttgtcttgattttgatgatccacatttcaagtgttcacttgctacatgtggctcgtggctggtgtggtgggcaaagtgggcctagcacagaagtgctctgtaattattactgttgttataattatcatcattgttgttattcagtgttgagcaatggagtcaaggactttttgtgggtgtggggtggtggttgtgtggagtagagcagcggaacaccctatttgcctgacttccagaatgccagcttgctgggatttcagtgcagctgaggcctcaagccagttaagcctatgggtcccagactcactggccagttggtgcccttcgtgcgatccacagactgttcaagtatccatgtttatcatatggtcatgtttatacttttgtttctggtaggaattaataatttacttatgatacttaataaaaaccagacatcacctcatcggtgtttaaacaaaaacagtgcaatttatcttattaattctggtgaggtcgtctgtcttctgctgttggatttggagggtggtgtgggcaggcattctatggggtcttaagccaaatggtccttggtcctcaaagtgtaagcttttggttcatgtgggtatgtagtgggtcactgtgggaggtaggatgatggagtgaggctgtggaaccaggaccattgctgggtcgagagagctagaatgctcacgcaggcagttggcctgcatacccaaggaagccagtgccggcatgtagctccaagtgagagcgttgcacactttataagcatgatctcctctattccctccaactcctctccgaggtacccattctacagaggagaaaactgcagctcagagaagttaggtagcttgcctagctccatgatggtcaaacctggcctctcccccagggtgtgtgactccacggtctctgctcttaaccactttgccacaccggaacttcctccccagaccttcctcactggagccaccctctccttggcatggtttttttcctgatttggaagctgactactaagtctggtcaagctctttcctcgcttgtgaaggaaaagtactttcccaaggaagttgaacaggtccgcgtgcagcagtggatacaggtttcccagctctcagaaaagagtgggtggaaggctaggtttcagcttttccttatcctgccagaggccggtggcctccctgtgtggacaaaggagccagcaagtgctatcatattccactttaaggatgtggatgccacatcacctgctatgctccagccgcgttcttctccctatagtttcttgaatttgccaagctcttccctgtctcttggcctttgagctagctctcttttcccaggattcagctgaagctgagaatatcaccttctcagagttgccttcctgaccactacatataagcagctctctatcacaacaatttgtttccttctggccattgattatatacttgttcactggtttactcatcaactgtctgattccccagtagaatgtttatttttacaagggcagagaacacatctgtttgatttactaatgaatttctcacacctagtacactgcctggccccaaataggatatcagttaaatatttcttgcacaaatgaacaaatcaagacggagattccccaagattcatggccactgtgtgaacctggaaaagttccttccttctctggggctcagtttttgcatctgtaaaacggccttgagatgacctctaagcttctttccagctctgaaattccacagctctctgatctgacattggaaactgctgagccccaccccattcagttattttgcctttatcgcccaagtatttctttagaaaagggggtggggatgttctaaagtagacccttagttcctttttgagcatctgggcaattttccaatgcttataattgcattagaaaccagcaaagttaacctagttattgattctggagtttcgagtctccattggcaagaccaaacccacaagttggcagcttggtattcttttttcttttctttctttcttttcttttttttttttttttatggtaatgttatgagattacaggttctgtaatctggatcaacaactctttcacttcataataaagttgtatttttaaattttgcttttgactttaattgcagccaggcatgaaacgagagaatgagggtgcctttccagatgagtgcacattcaaaatcattcaaactctacttggaagaggagaggaaaattaataatgagaacaaacaggcctttggaaccaggctccccctcctcccttcttcataaaatgaaatccttctcctcacagagtaaatggaaaaaacaccagagcaaacaaactggggaggtgctagcacaatcggttcttttcgtcttcacagaccttaatcaagtgaagacccaacagaactacgtacaggacaaaaccagataattcgacattcattcattcatcccacaaatgtttagtgatcatttattctgtgtcagactttgagctgggtgtggggataaaacagtgaataagacagaaaaaattcctatcctaatacaataatactattcatgacaataataataattgttgttcacatttgctatgtgcttagcacagtgaaagagctcttagtgaattttctcccttagtgcccacaacatttttatgaagtaggcacctttatgagttctatttactgatgaggaaactgaggcacaggggaatggagtgattgttcaggatcatgtggctggccagggcagcagcaaagatggctctgggggcagagctctgctaccacagagttgagtccaacagagcaggttggtgagctcataggcaattctaatatggtttgagaagtgatacgatggggacacagagaaaggacaggctggagaggctgaggaagaacttgtgaaagatgttttgcctacactgtgatctgaagaatgagaaagaatagctaggcaaagattgtggggcatctggaagggctaaaaatgtttcagatgggagagaagtgaaggagcaggccaaaaggggaagagagatgagtctggcagatagacaggaggccagatcatgaagggtccaggaagccaggctaagacctttgcaacctggtggtgatgggaaggccctgaagtagcaccatgtattagtctgttctcatgctgctgataaagacatacccaagactgggcaatttataaaagaaagatgtttaatggacttacatttccacatggctggggaggcctcacaattatggaggaaggcaaggaggagccagtcacatcttacatggatggcagcaggcaaagagagagaacttgtgccggggaactactctttatagaaccatcagatctcatgagacttattcactttcatgagaacagcacaggaaagacttgccccgatgattcaattgcctcccaccaggtccctcccacgatatgtgggaattcaagatgagacttgggtagggatacagccaaaccatatcacaccatgaacttcatgccttggaagggttatgtctaatggctatgtagacagaatgggctggacggttggaggtagagagatgaattagatccagaggtatggtggtccaactcaaggctgggggcagtggtgaagaacagtggtatatagatctgagacaatttgggatgtaaaaatgataggactttgtgacaatgcaaatgtccactgttgaaatcaggcaagtgacttaaatgaacaactttggctgtctgtggtacctgataactcttggctttattttgtgctgtatggacagggtcacatatcggaaaagtaggcaactctctaccctgaggggtcatcttctcacaagggcctaaccaaatgtccctgtgaagaacaccccagcattgatgtaacaaagtagccttttaagtggttgttctttacactgttttagtccctcatatgaattcctctgctaatttataagtaggatagagtgttttcccttgtaaccactgcttgaaagtgatttggctgggtgtggtggctcacacctgtaatgacagcgctttgggaggacaagacagacagattgcttgagctcaagagttcaaaaccaggctgggcaacatggtgaaaccccgtctctacaaaaaaaaaaaaaaaaaatacaaaatacaaaaattagctgggcatggtgatggatgactgtcgtcccagctactctggaggctgaggtgtgaggatcatctgagcctgggagtttgaggcttcagtgagctgtgattgcaccactgcattccaacctgggcaacagagtgagaccctgtctcaaaaaaaaaaaaaaaaaaaaaagaaattgatttaatcaggtatgttgtacttttgccttggttatcaagaagtttagcatgaatttttattcacacacctatattgctttggagggtatgtacctattagtaatctacagtttattgaatgtagtatctgctacttagggtataggactttgaagagatgggaaataggaaagggaagtgttgatggagacttgcaggttaggaacactttggaagctggagctgtgtgatggataagtaggcttgaaacaaacctgactgggggccatggaaggtctggccaagtcatcataaaagagcaccagagtcattggtaggagagaaagtagaaagccactggtcggaggaaagtgggctagaatgtggccacccagccttgttttctgcccttgtgttaacacaggcaacaaagccacagttttgaaagacttgaacagcaaattcaacataccatgattaggtgaatgtccacatggaatgatgttcaggaggcttagaaagacattcctagtttcggccaggtgcagtggctcatgcctgtaatcccagtactttgggaggccgaggcaggtggatcacgaggttaggagattgagaccatcctggctaacacggtgaaaccctgtctctactaaaaatacaaaaaattagccgggtgtggtggcgggcgcctgtagtcccagctacttgggaggctgaggtaggagaatggcatgaacccgggaggtggagcttgcagtgagccgagatcgcaccaatgcattccagccttggtgacagagcgggactccctgtcaaaaaaaaaaaaaaaaaagaaagagattcctggtttcctttatgcaaatatccttattacattttggctgttggtggctcattcattgcatcaaattattgccatcccagaaagtctctgtgaaaatgtgagtgcccctgagtagtgtcatgtaataaggaacaaatcatagcaactcagacctttgagctgaaagaggcctgtgggataattgatggcaaccctcatattatggatggggaaactaagccacaaggaggttaaccaaatgagactaaagtctcaaagccagttagtggcaaaacttggattacaatgcagatctctggcttctaatagaagatatttccacatcacatgattagaggccagttcgtgtactattcctttctaaagtaacagccgaaaaaagggaatgagatccagggtgaacaggttttgacaggaagggagatgagagtcagtcagggggacaaaagtccttccactccagccttgtgtgtagaggagaggccactaagcctagccgttcatagttctccacacccatgtttattgatattgactcaagcaagcagtgggttctggatccaagtggatccaatcagagtccctccaaaacgggacgtatggaagtctcacttcctctgtaaagactatttgacctatttgacagagactgcctgcgtgtgaaggcaacacagaaaaaagcagagcccaaacaagaaagaatgaggaaggtagagtgaggaggagggcaggagcaagaaacagatgagagagtgagagggagatcaagagattgagagagaaaatgcaagagcaagcaagcatctggaagaaataatttgagtaactggatccagctatgcctgaagccagatgcactctaagacttttcaatttatgggagccaataagtaccttttattttttctgtttaaacaagttcaagttgaagttgtcttacttttaactgtaaagatcccatttataataagcttttcatataaatctacttgatatttgcaggcaccttgtgagatagatattattataatcaccatgttatgaatgtgaaaactgaggctcagagatgtttagtgattggcttaagattatagagctttgtgaaatcagtctgtgctattcttcataacacgggtgtcccaatcttttggcttccgtgggccacattggaagaagaattgtcttgggccacacataaaatacaataacactaacgatagctgatgagctaaaaaaaaacaaaaatcacaaaaaagctcataatgttttaagaaagtttataaatttgtgttgtgctgcattcaaagccatggactgcagggttggacaaactagctttacatgatccttccttttttttatttactaaggcctcgctgttcaaagcgcaatctgtagaccggcagcattggcattacctgggggtgtagacaggaatgtagtatctgaggcctcatccccaaaacgattgaatctgaatctgcttgtgaacaagcccctcgggtgattggaatacataatgcactttgagaaacactgcattacgatcagggctgacttcagggtggtggggtattgagggtgggtggacatacctgagcagtctggacacagctctgtcctttcacggcatggtcaggggccagccgccctcttaatgctgttcttcctagcatggtgtgttaatatatcgttagctgctaggatcatgctaagcagataatctgctagataactacactggtcacatgaagtggatgattggactctctgagtctgagcctgggacgcttactcgatggagagagaggcaggctcgtctccagctttgtgtgggcagatgctgtgccagcgcccaggccgcggcctcaggaccacagcaagtctcggcgggaagcccacacgtgagcaagtctcctttgaggtctgcatgtgctgcaagcggaagcctgtggtcagcatgtggcagctcaaataatacgctccactagtgtgagaaagccacaacacagcacggagggaaccattcaccagaaccttctatcgcgtgtctgccgggcaaggtggccgctgcagctgggattggagcaaagcctccgagttcaccagtccatacgccctggagaatcgtgtgaaaagacaggtggaccatgacgaaggagagctcctataaacacaagcttaaaaaaggctgaagtctgcctgcctggtttatttctgccagcactggggctgggtgagaacacagacacatccttctacttctccggctccctgagagaacatgccaagttctgaatgtctctaatggagatacctggccatgcggggggttgacagacagaactgttttggggaccagttccaattccttggatgacttggtgcgtccacctcagcttttcttccatgttcctggagaaggaccattcattcctctgagccccgtggtccagcaccacaggaagaaaagtctgggagtcaccactcctctgacttgggagcacatttcgcctctgatgtctttttcctgaatgcatttcagctttactcttctgattctttctctcccatctggtttctatctgacccaagcagctgttttttccattgaaaagaacacatttacctctttcttcttcacatgccatgttttcagttttgaaatgctttttcatatggactgaaacagtctggattttcttttttttcttttcttcaggaaaagggagtacccgtattttgatttgggtatgtgcaaagtctttaagcagacccacagaacaatggcagtgaatgtcttcactcccctaatggctaggaagccattctgtttattcatgatcaccatgctccatgcacagaaagactctcagccatgactaatattagcacagcacagtatatataacatgttcagtcatgtatcataaatatttataaagaccacaggagcttttctcataatgcaaagagatgtgcccgagaagagttgagcagtatgtgttgggtgtttttggaaaatgaatagatgcccttttttccaaatgacaaaataacctcccccgctgacctccccgccgcactgaatttaaagatagttggaaggcaaagctctggaattttctctgttgattgaagtgtgggcagaacactttaccattggtgatggaagaatttattcccattttaagtaatgtttacctatccagccacgccataggaaaggggatccagggagaatttgaaagagtgaggtttgacattcaagacagcggccttataaaggagaggtgctgggaccaaaaagtgagtgaaatctcagctccaccattgtcagctatgtaacctctttgtactcgcagatttcccttccttctcaaggtcttcggacatgctgttacctctatgtgcaacacccttcccccgtttcgtgtggtggttcctttaggtctctgcttcaatgtcacctctcatagaggccttccctgaccaccctccaccaatgcaggcacagtcatttgccttgtttgtttgtttccttaattacatatctcttgttatatctttgtttccttgttttgaatctacctcaccctctataagtcttcataatggtaggtagggactgtggttcccccacttctcatttatctttttttaagttgatagactttatattttggaacaattttaggcttacagaaacattgagtagaaagtacagaattcccatatatttcctccccccagcttctcctgttactaatatcttgagttagtgtggtacatttgttatgattgatgagccactattgatgtcttattatcattaactaaaggtcatagtttactttagggctcacttgtacattctatggcccttgtcaaaggtttaatgtcatgcacccaacatgatagcatcatacggaatagtttcactgccctaagaataggctacacctattcatcccttcttccctgtcccaaacacctgacaaccgctgatttttactgcctccataggtttgccttttccagaatgtcatatgcttggaatcatacaataggtacccttttcagataggcttctttcacttagcaatccacacctcctccatttttaacgactgtattctagagttcctgacataagaagtgcccagtgaatatttatggaatgaacaaatgaaagagctttatgttgtcctaatttgcaaattgagtctactgtacagagttgtgaggatttgaagagtaacatataagaaggacttttacagtgtctagcccctggtaaaacctcataacggttgttactttttatattctggggttgtttctggatcttgatgatgctggtataggcctgggaagtgtttaaggtctgatagtgtgtttatgaaactcagacttttttgaaagctttcgctggtaaagctacaatttctcagtcagcctctgtatctccggatggccgctccctaaaattatggggcctttgggaaatcttggtgaaccactgataggatgtctctggtcctcgtttttcagtacaaaatattttcactatttgcaattttttagagtgattcctctttcaaaatgatcttagggctctatatttgaaatgtgcttacttcttttctcttacattctgtttagtaaccccaccttttcttgaagaaaatcttcacactgtttccagttccacttccttttgctgtggagtggaaattctgatccctttcctggtgggaacttgatgagactggcctagttgtaaaagagtggctggcccaggtgaagttttcatatcctttaactctccagtcttctgaaaaacccaggttgctgaaagaacttctgaaatgtaaaacgtgaaaagtgtttcacaatagcttccatccctggattgtgtaaaatgcttttaagaagtagaacatttctgtggcccttttaggtcaagatagaagttgtgtcttcagttcctatgttttgtctatctaatgtcacacatctgggtatttggaaataactaggtgactggccacatgagtgtgctggcattttgtagagttttaggatcatcttttagaacaataaagggtaatttttttttagattttaaaatgatttataccagaattggttaaaaatatatgactttgtcattttcaataggaaaaataatctgtttttttcctctgggaagaagaaagtgccacgacttaattaacaaagttgaaaaactgtaaaagaaatttctttcatggaataaccttaatcttcataggctactagttctaatagtttaaaataccagttgtaattttgcatctttagatataaatttgattccttcttggaacctgacctacttgtctgatggtcagatgaaatccaaagatgagactgggttagggcaggggttgttaagagctattgtacatgggggtcatatggacacttggtgcttattaaaaatgcagatcctgggccaagtgcagtgtctcccgcctgtaatcccagcactttgggaggccaaggtgggtggatcacttgaggccaggagttcaagaccagcctgggcaacatggcaaaaccctgtctctactaaaaatactaaaaattagccaggtgtggtgacacatacctgtaatccttgctactcaggaggctgaggcatgagcattgtttaaacctcagaggcggaggtggcactgagccaagatggtgccactgtacttcggcctgggtaacagagtaagactctgtctcaaaaaaaatcagatcccacttgccaccaagattctgacttagttgcctgggatatgagatgaggcccaaagtcttcatgcatgtgcaccccagaaatgtactacatcagtgttgcttaaactaatatttacagagcagtgttctaagtgatttacatttattaacttatttaatccttccatcaccataggaggcaggtatcattattatcttcatttcataggagatgaagttacataggaattgtgcagctcactgtcatgaggacacacagactcagctggttagagcagaactggagttcaaattccaacggtctggtgccagaagctgagctttcagccacttggctaccctctccctcatggattatcattcttttcttactttgaatgtggatgataaattttttttttcagtttttgcatgaatgaaaatttgcatctatatgtgcaactacttcagccatattgaatagaatggtcaggcgattacgtcaacaggaccaggtatacagacataagaccacttaaaaagaaatgggcacacccattagcatgggtgttatccaaaaaatggaaaataacagtgttggtgggatatagataaattggaaccctggtgcattgcttgtgggaatgtaaaatggtgcagctgctatgaaaacaatttggcaattcctcaaaaagttaaacatagatttaccacatgagccagtgattccactcctaggtatatactcaaaagaactgaaagcaggaactccaatggattcttgtactgccatattcatagcagcattattcacaatagcaaaaaggtggacataacccaaatgcccaccgactgatgagtagataaacaaaatatagtttccatacagtggaatactattcagccacaagaataaatggaattcagacgcacactatgacatggatgaatcttgaaaatatatgccaagtgaaataagccagacacagaaagacaaatattgtatgattccatgtatctgaagggcccagaataggcaaattcatagagacagaaagccaggtgctaacaggaggagggagtggggaagaagggaattgtttaatgggtacagagtttctggatgggatgataaaaaattctagaaataggtaacggtgatggttgtacaacattctgaatgtacttaatgccatagactatatatttaaaaatggttaaaatgataaattttatgttatttatattttgccaccagtgaaaaagacaaaaaaaaagagaagtaagtggcaaagagagaccaccagccaagtgagaagagacagtgaagcagtgactttgcatccaattcagattcttatctcagctcttggcattttatccagacaattgtcttcatgagtacccatttcagtgtgtgcatagacacaactgggataatttaagagagacatcactaaaatccatcaaatgttcaccttccagtagagaatcaatgtgttattaatgttaaaaaatgttaaaaatattttaaaatattaaaatattctaacaagtcctgagcaatacactaagatgaagaaagtccttctgattctggttacgggggtgacccccgtgttgctctgactgcagtgggtgttgcaatagctcattcataaatacaggcaccccagttattggctcatcacaggcacgtgttattggaaacagaatatgcaactttgacctccaaataatgagttgttgccaactcaactgaaagcaacttgtagactctatccagctaagggctgtggtttgagcaaagacaaataatacataaagcagagtttgttgttcagctctgctgaggatgagtacaggtcacaagagctcagttcaacatgtgcaatcagatatagacagcaaagaattcatatggaccaggcaacagaatgttcctgtgcatgggagatcaaattcattgtgagccatgatgtttagaagacagacttcatgactcagggatgaaggagtggcctctgactgataaaggaaatgattgtgttgagaaagattaaatatacatcctggtagggctaatgctagggataataaagcttatgatgaattctgatgaacacttggtagttaaataaacccacagtgtctctctcaactcatatagggctcttggagagtctttttaaacaattcaatggaaggagcgatgtgctaatctttatgacttcttagtgctaatgtcaacacctagacagctagtaattgccagtcaacagtattgatgagaacagctaatgggaataatttaggaaactcttttccctagaaaaacagtctatgtaggtaggtgtgaattacttcatttggttgaccaaatggacaacctgaaaactgttatttgcttttgttctgtggttgtgcctatcgtctctctgttcagggatatagggagagtggaataatattaatttctcaaatctctcaaaccagttaatatctctagaaccactgccctagctctagccactcaacttttgctggtgctactggagcagcctcctagctggtctcctttacctaggcttgcgaccctcaacccagtctccagtcctctgtctgaatgagctctttaaaatgtagattgcataatttcacttccctacttaaaaccctcaaatggcatcccattcattattcttgtaaaactttgtatattttttttgcttatccacccacacttttctctttttaaatctttttcaattgatatgtcatatttgtacattttttatggggtacatgtggtattttgttacatgtacagaatgtgtaatgatcaagtcaggatatctggagtatccattaccccaagtatttatcctttctatgttttgggaacatttcaagcctactcttctagctattttgaaatacacaatacattgttgttaactacagtcaccctactctgctatcaaacattgaaacttactccttctatctaactgtatgtttgtacccattaaccaaactctcttcatttacctcccccaacccacacacccttcccagcctcttatatctatcattctactctcaactcttggactcaagcaatccacccatctcggcctcccaaagtgttgagattacgggcgtgagccaccacgcctggctcattctgctctctttctctgtaagatcaacttttttagctcacacatatgagaacatgccatatttgtctttctgtgcccggctgattttgcttaacatcatgacctccagttccatccatcttgctacaaaagacaaaatttccttctttttaattgttgggtagtatttcattgtgtgcacataccacattttctttatccattcgtccattgagggacacttaggttgattccatatctttgctattgtgaatagtgctgcaataaacataggggtgcaggtgtccctttgatacactgacttctttcctttggataaatacccaacagtgggactgctggaagttctatttttagttttttgagaaatctccatattttcccataatggctgtactaatttacattcccaccagcagtgtataagagttcctgtttctctgtatctttgccagcatatattgttttttgtttttttaataatagcctttctaactggggtaagatgatatctcattgtggttttgatttgtatttccctgatgattaatgatattgagcatttttttcatatacctgttggccatttgtatgtcttcttttgagaaatgtctcttcattgttcttgcaaagctttaataaatgtttatgcaggccagctggctaggccttgctagatttagtcccttcctggcattccagtacctgctcatgcctctggccctgtgccttaccccccattctgcttgcaatgggcacaccaaccttctttcaattctgtgaactaacctaacgctttccagctgcacagcctttgccagtgctagtccctctgcctggaatatccttgccattagttgtgatgtggctatgtcttacttcagaccccaattgctatgtcacttcctcagagaggcctttctgggacaccacatcaaaattagaaactctgcgtgctctctttctttcagatccctttcttccatagcacttattatagttggtaactatatttgtatctgagtgattatatatttaacgccagccttctactgcactataagcataaaaagtataatgcatatcttatttattaatgcatcttcaggatctagcaagtaaactggtacactaaaagttgctcaataaatacttgctgaaagaaacatatttaaccataagatgctcactgtggtcagaaataagatgtaggtggagacgtcttctaaacaaaccaccagcattctttaggactctgagttagttttattactgtctgggtaccttgttaaattctgaaatcaagatgatggggaaaaatttgactgatcatttaaccttcatttatatttaacatgactttcccaaacagatggggggctatgccagccttgtaagtggatgtacaaaatatgtatggtcaaaatgcacacaaagcaattccatcaattcccttcttttctgtgattattcctcaacttattgtgaccaagaatcagtccagtatttggcaacaagaggggtgaaaatgaaccgaagacatgagcaacaattgacatggaatccctaggtgctcccagcagacccacattctcaagaaagccaatgcaagaggtggggcaaagaggggcagaggataagaaatttattttctgacccctacttaatggttttaggtccactttgaccagggaagaaagaactgtttttaaaaatgactcactttattcttaaatgtctctaagagaaagaggtgctacaatctccacagggaggaggtaaaaattaaatcagataatcctgggaaatgattttgcaaagtggctgtcctatagccagtgctcaatcacactgagtgttcagcaatgctgggagagcctctttcaaatctttagtcttggaatcaatactgatcatcttagaactctaactcttatggccaaaaggtttttgataactcaaacttagattttcttccctgtcgcttcacagtgttttgtagcctttaatatttcctctacctttcttaaaatgtgaaatttgaaagtaataagtatttcatgttgatgatgtcttagagagttggggtgaattgttgggtcctagcaattagccaaatagccaagcctagattttttcctttcctttctttcccggccctcattatttgggtaattgcatcaattctacaattggttttacatgtattgccagagtctaagctgtgcaaaaagggatgtcctttaatgatttcctttgaatggctttccatctagggaggaagagggcccctcttgttcaaaaacaaaggaatcatccatcccaccaagacctttcttctctattaagtatctcttgaatttcaaaggcggacttggaatttctcagtcccaatcttaacggcagttccagactgcagtttattttctttgtccctttaagaccagaaaacattacagcaatgcaataactgttcttatttttcttgggttcaaaacaagaccagattccaatctgctaaagcttaccatttcacagtaaccaagcagttcatgattatcagctcaagcatacattttccttccaaacaaggatatggctactagcggcaacagctgtattttgctagtcaatccttatgttaaagatttacagttttaaattctgtcacttggtttgccaactgttcttcttcctggagctgcccagttgtttctgaggggacttgaagtggtttcctagctgtttcaacgccctgaatgacaatgcatcctcagagtcagactggagaatggaattccctgtttatatccacaagacttctctcgctctccttcttttttttttttttttttttgagagggagccttactgtgtcacctaggctggagtgcagtggcgcgatctctgctcacagcaacctccgcctcccgggttcaagtgattcttctgcctcagcctcccaagtagctgggactacaggcatgcgctatcacggctggctatttttttttttgtatttttagtagagacgggatttcaccacattgaccaggcaaatctcaaactcctgagctcaactgatccgcccgctttggcctcccaaagtgctgggattacagttgtgagccactgcacccggcctctccttcttttaaacatatgcagactcaccgcagaaactggaaacagattaaaagaaatgctggcttttaaggcgagtttgaaaaacgtaaagctgggagccggcttcccgctctccctggttccctttttgtgttctcttctgtgattcatctgctctaatccatcaccgattcatcatgctcatccatcagacccttcaaagcaaaccctacagctgcttttgccatttatcagtgggaaataaaagggaaagggggaaaagtaaggaaaatatcacgacctttctgggcctgggataatgggtgtgaaaaaagggtggagggaaagcttatctaatgaaacccagagcctttctgggatgtgagttcttgaacaaaggattatgactgagagcaagaccagcagccagtctgcagtaaagtttcagggataaagtctgccagaaacaaaaggtttagtgggaaactagaggaatgtggacaaaatgatatccactccagaggagtttaaaacctaccaatattcatagaaatttgttgtctgtgaccagtctctcagctttcagctgtgtaatagaacatgggcattcaggttgagaggcaaacatttgacttcagtgcccttccttgcaaactgggaaatgactgatattgtaattcaccgttctcattttcataagatgccttgcaagtcctctgccatttaaacacaactgatgtgccttaattttgaatttgtcatgcaccagatttttattttttatttttaaatttttatttatttatttaaaaaatagagacgaggtctcactatgttgtacaggctggtcttgaactcctgagctcaagtgatcctcccgtcccggtctcccaaagtgctaggattacaggtgtgagccactatgcctggcctcatgcaccagttttgctctcaaatttgagaatcaaaaaataaggactgactcagtgattccacttctagtaattcagcctatatacgtgtaatccatgtaggaggttactctctttgtcatcatagaaggtagaaacagcccaaagtttcatcatcaatgtcatgtagcttttagaaagaatgaggaaggtaaacaaactgtggacactatggaattctatgactcaccaataaaagggaataactacaaatgcatgcaatgaggtggatggacctcaaaagcaagagagaacttactgtatgatttcatttacaggacattctagagtgggcaaagctattttatggtagaaaaagaacaagagctgcctctgagggtacaaaggtggggactgatgggtaaagggcatgaaggacgtttctgggggtgatgttgataccttgtatcttgataggggtttgggttacacaaaagtatttattatccaaactcagtgaattttgcacctaagatttatatgtttatcaaagcttagagaatatttacttaaaatttgtgcattttattataggtattttttttaagtaaaaagttataaaccagtaatgaaattctgactaagaatatgcttgctcgagtatttggataaaagtctatttatgttttctatttactttgaaatgcatcccaaataatatggattgctggatggatagaaagatgactgatgggtgaatatttgataaagcaagcacagtaaagtgttaatggtaaaacctaactggtgggtattcacaggcattcctggtaaaactacttaaatttcactctattttgaatttgtgtgtgtgtgtgtttgttttttgggttggtttttttttttttttttttttttttttttcctgagatgaagtctcgctctgttgcccaggctggagtgcagtggcacaggcttggctcactgcaatctctgtgtcctgggttcaagcgattctcctgcctcagactcccaaatagctgggatttccggtgcatgccaccatgccagctgatttttgttatttttagtagagatggagttttgccatgttggccaggctggtctcaaactcctgatctcaagtgatctgcccgcctcagcctcccaaagtgctgggattgcaggcatgagctactgtgcctagccaattttgaatattttaataaagttttgggaaacaaaaaaaaagaatgaggaagctttttatatcctcatatagacttttttccagttttattgttaggtgaaaaaagttgcaggccacgcacggtggctcacgcctgtaatcccagcactttgggaggccaaggcgggtggatcacaaggtcaggagttcaagaccagtctggccaacatggtgaaaacccatttctattaaaaatacaaaaattagctgggtgtggtggcatgtgcctgtaatctcagctactcaggaggatgaggcaggagaatcacttgaacccagaaggtggaggtttcagtgagctgagactgtgccactgcactccagcctgggcaacagagtgagactctgtctcaaaagaaaaaaagttgatcggccgcggtggctcatgcctgtaatcccagcactttgggaggccgaggttgggggatcacgaggtcaggagatcaagatcatcctggctaatgtggtgaaaccccgtctctactataacacaaaaaaattagccgggtgtagtggtgggcacctgtagtcccagctatatgggaggctgaggcaggagaatggcgtgaacccgggaggcggagcttgccgtgagctgagactgcgccactgcactccagcctgggtgacagagcgagactctgtctgaaaaaaaaaaaaaaaaaaaaaaaggtgcagtattcacagtatgctgccaattgcagaaagaaagaaggaactcatatgcgtatctgagtctatgtgccgatatcatctcttgagggagaccctagaaatggattaccgtagaggaaataacactagaaatggttactttagaggagggaaaatgggtgcctggaggggaggtgggaaggagagagcatattttaaatcattatgatgatttaaagggtaaattattgtatacttttggattttgtataggtgaaagtattaccaattcaaataaaaaaaatcaaaagcaatagtatatgctagagtcatctcaaatgtctacaatgggctccctttgcatggctgacatttggaatttattctcctagcatccattcaattcatctgatgttccctaatctcttatgtgccaggcatggtgccagactttgtggatagggtagggaattgggggcagctgtgtccttgccctcactgagcttactgatctaatgaaaggatgggtacacatttggaatggatgtaagttctgatctaacctagtctggggtgtgggtggggtcaggaggcatttttatacaaggaaaaactgagctaataaagaaaggatccccaaactagggtggggagaacagcatgtacaaagcttctgctggggatggagcagggtggtttaagtccctgaaagaaggccagggtggcggatcacgaagaacacagaggacggacagaggagatgaggagataccagagaccacattcaggatattgatctttatcctgttgtttaatatcataatgtactttctgaacatcctttgtatgtcaagaaacatttttctctctgtagtggggtttttgcccccacaggttctaagagaaaatgggagcagagcttgttacatcccttcttaggagaaatgaagcacctcactaaatctcctgacatatcaggcactcatatcttcttttcaaggatcagagcctgcatttcttgcctgagggctttctttggctgctggggtcttctctgccccgtgaagcaggcaaatggtatcctagagagttaatgccccccgagaacagcccttaaccaattgatagaggaggtagaaagaaattatttaggcagatagtgagggcaaaagagcccttggcagaatttcttttctaacaaaaagcagcccccaaagtcattccttttctaataaagagcagcatgaaaaatctagctgcaaacatagataaagctggaagcttgcacggggaaatgctagtagctccaccaacagaaaagggctacctgggggccaggcatgtccaacatggagactccatcttccctttttttgttgttgttaccacgtgtacagtaataaagaaatgggcaacatggctcaactcaggcagagaacccacctgcataataaaagattagggtggaagctaccagagattctctccctatagaaatggcacacctgttctaaccagtctttcatggtgtatgtaaatcagataccacctcctcaccagctcatctataaaaccccctgctcgtaaactcactctttgtgtgtctgcgtccttgttctccatgggacaacaaacctcatgttgccgtgagacgacaaacctcagctgttactccagacaacaaggccatttcacaatgactgatgggagttggcctattcataccccagctcatctacattgggcttccacaggcctttttgtgtttttttcagtggcaactggggagagagttggctttgatgagttcagttgcagagtttggacttggttaagatcctaggtgttttgacctttctgaacccagccagtatttttttgatctttaatctcactaaatataattgcagaatatacactcatttaagaattatattggcttccattttctataaaaatgtctaactcatatgctagcgtatggtcactttacactcttttatgggattcctagatgggccagtatcaatattctccttgaaattatcaagaaccaaataaacagatgccagatagtctgattggaacgaaaatcttacttcatttgacaatttttttctgaaggactgttacctttaaacctttaaactagtccacatacgtggtacagctaattctctacatcccatctttcacatttttcacttgttacttttgaaaaattagtggaatttttcacggagatcagatgtgaagaaatctatggcagggtgaaattttctagtctagaggctgcctttctatgaaggtctcatttcccttcctttttaaaaaaattaggctgttttagggcgggtctctgtgggtgactcaaattaaaacctttttagtttgggaagctgaagcaccaagatattttcacgctgggattacttgtccagatggtttgagcacaattttcttggcatgctcgtaagaacacaggaattttcaggggaaaccagagaacatagtagtggggagggtaggtgggggagggcaagtcagggctgagaaggcagaaataaggtttggattccaccaaatggcactgaccagctgaattggaatcagtcctagttatagttggcacgggtacccctctctccgctccaagatcacggactttccctcttcataatgggaattacctggctttcctaacagagaacggaggggggaagaactatagggaaattcatggagctgatgaagataacgattgaggtgcagcccccaaacctcaccatcaggaaagcattggtcaactcctgtatgcatgcatgggacaccgagcaaggtggggaaggaggggtgtgaagggcagtgttaggcctggaaacacagcatgggcaggcaactctctttgatagcgtcagcaaccactgcttaaaaacacagaaattaaaaatggcaggcagaattctgagatggctcccaagatttccaggacctgatgcacacatactttccgtgtatgtgaatcatgtacagtccaacgtgattccaggtactgctgtgaaagatgtacgcagatgtcattaaggccccagattagttgattttaggatagggtgattatccaggtgggcctgaactcatcacatgagacctttcaaaggagaaggtggcagaggtggaactcagagagctgggtctctgttgacctgggagaaagcagacacccaggtttgtgaaagcctgtggaggatgtggtgatggactggggtagcctataggagctgacagtggtacctggctgacagttggcagaaaaatgacctgcatacttagaagagcacccaaagccccaaatgagaaccacagccctggttaatatcttgatttcaacccagtgaagctctgaacagagactccagctaagtcccatgaacaggcctctcacctacagagctggaaagataatatatttgtgttgttccaacctgctaaatttgtggtaatttgttccacagcaaaagaatgatgaaatgttatgacaatggataggtgaatagtgagagaggcagtgcagcatggaatcaagaaaatgagctctttcttggctttttttttttttcttttttgagacggagcctcgctctgtcaccaggctggagtgcagtggcgcgatctctgctcactgcaagctccgcctcccgggttcaagcgattcccctgcctcagcctcccgagtagctgggattacaggcacatgccaccacgcccggctaatttgtttgtattttagtagagatggggtttcaccatgttggccaggatggtctcgatctcctgacctctttatccacccgccttggcctcccaaagtgctgggattacaggcgtgagccaccatgcccggctgaaaatgagctctttctttaaacttctctgatgaaaatcctggctctgccacttcatagctgtgtgatttttaaacaggtgatctaaccttgctatatgtatttcctcatgtgtaaaaaaagatttaaatagtaagattaaaagaacattatgaagatcaaatgaaataatatgtatcaagccctaagtcatgtgtaaaagccacgatgtatgttaacttaatgagtgctcaaaaaataagagttatcatcagcagccataatctgtggatcatatagcacgtgtctggtgctgcacaaggggccttaaagaaattaatcttcaaagaaaccctgtgagattggattccccattttacagatggggaaactgcaactcagagaggttcaataacatgcccaatattatgcaactagtcagtagaggagccaggacgaaaactacagggctctttgatcctaaaccccatcctgtgaactgctattttaagtcctatgcacagtgaagaggttgtaactctccaggttgttgtcctgaggagacccagggcaccaagattgggattcccaaactgccaggtctctcaaaatggagcccaaatgatcccagaactttgggaggctgaagcaagaggattgcttgaacccaggagttcaagcccatcctgggcaacacagggagatcccgtccccataaaaaattaaaaaaggagctgggcatggtggcacatgcttgtcatcccagctacttaggaggctgaagtgggaggatcctttgagcccaggaggtcgaggctgaagtgagctgtgactgtaccactgcactctagcctgggagacagagcgagaccctgtcttgaaaacggaaaaagatccccaattctccagcactgttctccactccatgggattctctctgctttgtccctgtcttgtatagttccctcctgttcacccctcagatctcctgacctcatagattagaccaagtccacttcagtgcactctcctaaagtccttctttgtagcagttcttgcattttatcattatgtgctagaccagtggttctcatctgtgggcaatttttcccatgtttgtcattgtctggaggcacatttggttgtcacaatggaagcaggtgctcttggcctatagcgagtggaggtcagggatgctactgaacatcctacagtgcagtgcccagaaacaaaggataatccagccctccatgttaacagtgctgagtctgagcaactctgtgctgtgccgtaggctccacagggctggggttgcatctgtatttccccagtccctaggatgaccctctcaagagaagtttattgaaggaatgaaaggaagataaacggtgaatctcaggtcagccttgttgctagctctgctccactttctgtagtttcaaaaaactgacctcagtggcagagagtaactttgaaacttatgtatgtccttggaaaaggggaaaataaatgggcaaaataagtccttggtaaaggagttagagttctttcttcttcgccctcagtggtcctgccctcttcagcttttcctaaaattttaactgattttttttcccaaaataatctatgtttgatgaagaaaactagaaatgcagatggcccaaagaaaatataaataatccataatcctattatctaaatataaaagctgttaatatcctagggcatatccttccagttctatatctatatatatatttaaaacaaaagtgagattatgctgcacatataaatgcaaagtttttgtaagttaagagtaattcctgaacattcatttattcatttaccaaatatttctagtttccttctagtgcgcaggtacatataggagaaaaaaaatcatttcatgccattatatagtttttctttctctttcttccttcttcctttcctttcctttcctttccttccctccccctgctcctccccctcccccccttccttcctttctttctctctttctttttttgagacaggatctccctctgttgcccaggctggagtgcagtgctgcgatcacagctcactggagccttctcctgggctcaagtgatcctcccacttcagcctcccaagcagctgggactacaggcatgtgccaccatgcctggctaattttttagattttttgtagagaccgggtctccctatgttacccaggctgatctggaattcctgggctcaagcgatcctcttgactcagcctcccagagtgctaggattacaggcctccatcatacagctttccatagcatcagttttcatgactgcatgttattaacatcaaatggctaccccataatttattcagccaatactctattatcagacatttagatggcctcctcctctctttttttcttctcttcctataccctttccccttccctccctccctccctccttccctccctccatttcctccttccctccatccatttcctccctcattccctcgatccattcctttcttcctaccttctctcttcctcctcctcctcctcctttctactataaatgctgccatcatgaacatctttgtggcttaacatttacacatgtccctgatgacttctacagaatcaatttgcctctcactgctttggaaaccactcgctgtcacagaatttaaccaagaccacaggtccagcagcaaacacacagacatttcaagtggaaaaatgcgttttactccttctagtaacaccggtgggagagtaaggttgtaggagaagcaaggcaggatagccaattctcacttgagatgtggttttcacattgtctaaacctgtttgggcacatcagcctttagcagggagcaactttattgtctcttctgccagaggcttcccaaaattctcaacttcttttttagttcccagtgaagagtcttgacatttacagagagttaaagaagaaaacgatgtgcttgtggacaaattaaaatagacaatgccaactggccgggagtcatcatttctgtatatgagaggtggggagcccgatcaaagccctgagtaaacagcttacagacacaaaagacaaagtgttttgttttctgagcactggaaattcaggaacaacctgtgtcagattttgcaacctttgcaagagtttgggtatcataacatagcgatcttactcttggagccattacagagccaatcaccaaactaaccaggttctttaacctggaagctaaagatggctatggaaccggcccccccacatcagatatacatttggggcactggggagcaagtggggttggaatgaaggtgttggtgacaacatggtatatttgcaaaactaccaaagtcattccctctctcacctttgacaattgctgactgtatactgacattttgaacttgaagcattctccaggtgagcaaaggacaaagggagaaaagatatgctctagtcaaagaaggaacacaccttgtaaatgtgggaggtgacttctggcattgtattctcaagacataaggggctgagctgcaggaagaagccacccaaccccaaagcatttaaggttgtgtggttttcctgggtataaagcacaggaaagagtccaggggaagggaggaatgctttgttcataaaatacaaagctaagcaaacagtgcaggttggaaaggaattgtaatgttttaatattgtgtaaaagaatagatgataaatccacttagaattgacgggagcagccgtgtgaataatccaaaaagcattgctccaagtctcgagaatgaataatgggatcgcttgccccagcatatttctctttctaagtatgtttcctgtagtttattgttaaaattaatgagcactccctgagtggctggggaaaggtgacctgtatgttgggtgacatgaagaaacctccctgaggccaaaacattcctgcagataatatatgcgtgatcaatgagagttcactgggtgtattaattttgattaaaaaaacccttgaatccattcctgttcattgatagttttaatgtggtgattccagtgtcctgcacacgactaatcactaaagtcatatcctctgacctaccatatattcactgtctcttatgaccctgttttattttcttattttattaccaccggatgaaattatcttgtgttattattttttaaacttcgaccagaatataagctgcaagaggttgaggaatcccgctgtcctgttcactacagtattctctatgcctaatacagtacctggcacatagtaggtgctcagtaaatatttgcagaggaaatcaacacgtttccatccaacacactttctaggaagaaagctagtgctctgtgaagattcagtgtcagctgagcttcctaaaagatcttccactctcatctcttctttctttttttctatttaaaaaattaagctataagttacaaacagtaaagtacatcctccttagtgtgcaggtctgaaagttttgataaatgcatacagtcacgcaaccaccataatcaaggtatggaatagatccatcattcccacagttcccctcgctacccctggtaaccattgatctgatttctgtccttatagtatgaaccatttaaatctggcttctttcacttagcataatgcatttgagattcatctatgttgtatgtatcattaattagttcctttcaattgccatgtagtattccattatatggatatagcacagtttgttcatctactctccactggaggggcatgttctcatctcttcttatatgaaaatgctgtgcactcacaggggctaagagcagaatttttaggatcagaaataggattggattcttggcctgtcaccgcttagctgtatgacctttggacaagtcagtgaaatgctctatgactcagttttctcaaaaagagaagtgaggataacttacataatttatttagcacaaagtctggcaaataataagtgcaccataaatagtaactctaatcattttttggggggagttgggaaaggtcctgcttgaatttcccttgctctgatcacctcaccaatgtttaatcattcagtcttgctatttaactggtctgaatcttatttttttcacctgaaaaatgagggtaataataccagcttcacataattgctagcagactaaatgggctaataggcataactatcctaatgtagtgtgttggcccagaagaaaggatggttagaatatgggcacttggtgaatatgactcatataccatctttaaggcttgcaggaattagaaggaagcagagttgtatagatgggagatggaggaaggctctggggtcaaactgcctgggtcccattcccagctctctgccttcctacctgagtgaaactggacaaattacttcacctctctatgtctgttttttcatctgacacatggggataataataatacctacctgaagggttgttctggagattacaaaagataatgcatgtcaggtgcttgggcacacagacttcataaatgacagcagggaagatggttagatattgaacatgcctgactcctttagatggcctaagctttagttatctttgtattataatattatattagcacactttcaagaacaatgtaggagctcactgcatgtttgttgacctgaattaatctaaagaacacatttccctttgggtcacattacgatctcacatgttatcatgtattttgatatccaatgtaaacaaatttttcaaaggatatgttgcaaaactgccaacagtgagattcagaaaagcagttgaggatgtacattattcttaaaagaaggctttcattaggatggttgcatgaaatttttcatattggccacttctttaggagaaatcacccttgattcttctgaaagagacctttgacatttcacttgtattttccttcatagatgaacacattgagtttctgtgatggcctggtagcctttggacatcagacttgtctgttttctgctctagaattggcctgctctgtgacttcaggtaaagtgactgcctcctctgtgccataggcgctccattagccacctgtgtgcattgcagtgttaaatcaacaattctttaaaagctgcatgatatccacaaagatggtgggtgtgtgttggggtggtggaagacactatagaagttattctcattcattataaagaagtgagggggtttggacattatttggtaagaagatagccttgtgtagactatactactcatgcatgtcaagttactaagtcctcattaagatctatttatgtattcattcatttattttagaattgtcaaccacttatgttgcccagctgtcaaaagacagccacccttggtggagggcatgtgattgcataaggaaggttttgcatcacattcttttggccactgaaaatgtcaagggtctttaggatcaaaactggtccaactggagtgaatctctaaactgaggtgggaactaccagaaaagaggctcattgtttcctcctggatttgacatcaggagcagctgctgttgactgtcctgacactccaggagacacttcccaagaacaggagaagctgggctcaggaacatagagagaaatgagatcctaatgacggggtcagaggcctgactccaaatgtgcctgaaagccaatctattgatggctttttcagttttgtaagccagttagtctgctctctcatacctgctttctggcctgtgctggcttgggttgggttgtctttggcttgtaatagaaagagtcctatttaatattaaaaccagttatttatgagatcttgggggtaacttagcaactctgagcttcaattttctcatctgtaaaatggggataactaattttttttaatttatttattttgtttttgtttttcaagttttctctttttttaataaaaagggggataatttataatgtgtagttttattgtgataattagaaataatactagtatatagtaatacgtgaagaaaaccaaatgcttttcaaatgtcatcttcctagagagggatccccgaccctcctatttaaaatttctaagcctcaaccctctccatctccataagcctgctttatgcttgtagcatttattttctatctgtggcaaagtgatttctttaatggtcccaactaatggcttccctgtaactgcatcttttgtcctgtaactttatagactattgcctctctggagctggactccatcatgtgactttctttggccaatgagatgttagcaaccatgatgtaagcaaacacttgaaaagcatgtgtacatttccgtttgccttcttgcaggattgggttgtttgcctttgtccctgtctgaccatgggaacatgactgggctagctggctggagggataggagagagacatggaccagaatggcctagttttgtctagctgaccccagatgtatgagccctcagttgcaactttgccagctgccttccagacctgggagcaaacccagctgagaccagaagaactgtccagcctaaatcactgatttacagaatcaggagctaaataaatgattattgttttaagccactgaaatttggggtggttcgctatatagcacaggctacctgatatgctaacataccatctaatttacttacttgttacgtgtagtctctctctcccccatctagactgtgagtcccaagagggttgagatttttgcctgtgttattcagagccatgcccagtgcctagaacagagccttacacacagtaggtacttgataaatacttcttgaatattaaatgaataacatataaagtaccctacaaaatggcacttgggttgatgtttaacaaatagtggctaatataatcataaggttaaacatttttatgccagaaccaacatttttttttttttcatcagggtcttctgttattttgcccaaggacattgttcaaaacatgggaaaaatacaagtgaccctctcttggatacatgttggtagatgggggttggcaataatgtcagataagaaacttaattatttttctttctaaattgacttgggactgtgggcattgtggagacatagcctcagtctcttcatttattggttctctatgtacctccctagcagccccagtgggtgcagcagggctgatatttatgtgtgtacatagagcaaaagagagattatttccgctaagaggccacatatatagcatatatattatagcatatataattttctttcaaaatcatcatcacatttgaagtaattaattagttaccaggttatctgttttatttctgtcttctgaaccaggctatatgctccataaaggaagggatcacttctattttactcattattataccctcatcatccagcacggtgcaagtgttcaaatatatttgttgaataaatgaaccatgcccctgttcattttaagaatgtaacctacttgaactgaagggctatgtctttctatgaacatggtgtgaacttggcattgtggtagcagttcacgtgtgtgcaatcgctctcatttttaggcaaataacaagtacattttattgaacccttactacatgccagatactgttctaagcacacggtgtactaactcactgtggaggtaaatattgtaataagtgccattttacagaagaggaatttaaaacacagtgcacccctcttggaatattgtgttgtaccttgggtaagtcatgctccctctaaacgtctgtccctcatctataaaataagaaggtcaggttggttagagtaactttttcttctatgtgttctaagaagagctataattctgatatgttctgggaaaataaaggcttttgtggtgagaagaattgtgttccataccacatccctctggtttacattatttcagtgtagccatgtggaaagttccatgcatgttcccagagttctttgtcaaatgcttcttttggcatctctttgctgcctcagagctttctccaaagacatggagagcagctccaccagtgtcttagcctgttttctgctgctataacagaataccatagactgggtaatttatgaaggatataaatttctttgcctcatggttctgaaggctgggaagtccaagagcatgggactggcaaatggtgagggcctctgtgctgcattacctcatggcagaaggcagaaaggcgaacaagtgcatgagatatcggaaggaagacaaactaattctttaatcaggaacccactcctgtaataactcactcacttctgcaataatggcattaatccattaatgagggtatagccctcatgacctaatcacctcttaaaactttaaaatagcaattaaattccaacacgagtttgggaggggacactcaaaccatagcatgtagctgtaacccaggaagtgcagggcacttaacttcttaggggcaacctataaccaacagagaatgtaagccctggttgcttcgccttttagtggcacaatttttacgtattttttatatggtccttcttagattttccagcaatactgatttctacttgatcaccgtggaaaccagcccattatgcacttttattgccttttgctttttcttttcatactttccaccccctcatttctgatcactggaatcaactcccaaataaactacacttgataccaagcttttgtctctgcttttgggagaatctaaattaagttacaatgtcaaataatttggggaaacactatatgcttgttcttctctcagacattcacgatacacaccaacacagtcaaggctctcagtagtcctgttgcaaactaacctgtccatccagctttcttcagctcaggctttcccagacttcactgcccgcgaacatttttttatccctaacatctttcaaggtaccctggagtaggtgttccatgaaatatgctttgagaaatgttggctggtgtagtctcaagggtcttgtcccttattattattctggatggatccagtagctttagctgccattccctggcatggagccaacagccaaatagaactctctggatgggagatttctcagtgccagggagcaggaccttcagacaaggcctctccaaaagtgggaaaccttttttttttttttgaaaaccttttttgaaaaccttttctcttagaaaaagggctcttccccttttcttcatgagatgatcagcctctgcggggggccaggaatgtttggctggctgggctgggagtgcagctgtgggcatcctgagaaaaagcttcacttttggatgacgcaggagcctggatgagatgaacaggaaatgtttgccaaccagcctgcctgcccgcactctcttgctaacaagcaaccatgggagaatttaactggcatgtgtccagggaggataattatttcctacagtagtatacagaagggcacctgggagacccagtgattacaggggcaggaggatgtgcatggaagcctggggcttggggtctgtggcctcccagtgggggctggttggtgggagtgaagaggggtgaccagcagcccatccatcttcctttccccctcaaagtctcaaattgaaggaacagtattggggagcttggatttggggcatcgggttacacttgagggaaatgcttgaaaatgacatcgtttttaaagaatgaaaccagtgaaaattataacaataataatggcggtatcaatttctgaattctttgttgaagaatgtacgcatacagccttttatcaagtcttttatatttgatgattagtctgtgttgggacttctcaacctcagcacttttgacattttaggcaggatgagtctctgctgtgaggggctgaactccgcacagcaggccgcttagcagcatctctgctctctccccaccaaatgccattagcacctctttcccctcaattgtgacaaccaaaaatatcttcagacatgaccaaatgttccttgggggtgcaacactggtcacggatgggagccactggtctataataaagggcagtagattataacggttaaagcctaggttttgagccaggttttttgttttgttttgttttgttttgtttttttgagacgaagtctcactgttgcccaggcaggagtgcagtggcacaatcttggcttactgcaacctctgccccctgggttcaagtgatcctccagcctcagcctcctccctggtagctgggactacaggcgtgcaccaccacacccagctaagttttgtatttttagtagagacggggtttcactgtgttgggctggtctcaaactcctcaggcctcctttgggaggccacctgccttggcctcctgaagtgttgggattacaggtgtgagccaccgcacctggcttgagtcaggctgttttgtccaaattctggttctaccacttttgttgtgtgaccttagtcacactatttaacctctcttgtgcctcagttttcttacctgtacaatggagataataatagtatctgcctgatggggttatggtgaagattaaaaagtttaacatatatgtaaataaatattttaaagcgtttaacacagtctggcatatagcaagctttcagtagtgtaaactcttattattatcataatcatcatgattttttgtttactctttgctcctagactgtaagctctctgagtgtaaagactaagtctttttattttttaaactataatgtctaggccaggcggggtggttcatgcttataatcccagcgtttgagaggccaaggcggtcagataacttgtggtcaggagtttgagaccagcctggccaacatagtgaaaccccatctctactgaaaatacaaaaattagctgggcgtggtggtgcacgcctataatcccagctactcaggaggctgaggcaggagaattgcttgaatctgggaggcagaggttgcagtgagttgagattgtgccactgcactccagcctgggcgacagagtgagactctgtcttaaaacaaaacaaaacaaaacaataatgtctagcagaggtacttaataaacattgaattcaagaagagaggaaggaaagtaggaagaaaggaagaagcttagcaatggaacttccagtgtccagatatgagagagaaagattaagaacctttcccagattgctggcctatgcactgcagtctgaatctagggctctcccggtttcagtccacaacctcaggtggaagagggggcaggggagagaagccacgcaaaaccccaggggatgtgtaaaggggcctaaatgcaaaactttaagtaggcatccagatgcatggagacgagcttgaaatttcttggagctggaggttgcaggtgggctctgtgctaagtagaaatgattgctacagcctggaagaagcaagaagctaagtaggaacgtatgctgtctgcttgtgcgccaagaaggactgaagtatggctaagagtgtattatttactcctccatttacaaaacccgtgaagaccatccatgagcttggggtagaagcctttagatggagggctgaagcaatgcagttgaaggagataaggcttcaactgaccactcagagcagggtggatctttaagtgctaggatgcgggaaggctctagagcagcattgcccagttgaactttctgcaataatggaaatgtcttgtatctgtgttgtccaatatggtagccactagccacatgtagctaccaagtatttgaattgtggctagtgtgaaggactgaattttaaattaaattaaagtaaaatttaaatagctcacatgtgcctagtgactactgtattgaacaacacaggtctaaaagaagccatatgcctttaggtcccaggctctccaaggacacactgagagatggtgggctcactgctctcctggaaaatgattaggcatgaatccctattacttctcacccatattcacgtgccagacaggctaactggtgccctgttccagaccaaccgacctaccttccttccttccttcttttctttctttctctttctttccttccttcctttctctctttccttccttccttttctttctttctctttctctttctttccttcctttctctctttctctttccttccttccttttctctctctttctctttctttccttccttcctttctctctctctttccttccttcctccctccctccctctctccctccctctctccctccctctctctctctccttccttcctttctttctttctttctttctttctttctttctttctttctttctttctttctttctttcagggtctcactttgttgcccaggctggagtgcagtagcatgatcatggctcactgcaacctcaacctcccagtctcctgcctcagcctgtcaagtagctgggactacaggcatatgccaccatgcctggctaactttagtttttgtagacacggggtctccctatgtttcccaggctggtcttgaactcctgggctcaagcaatcctcccaccttggcctcccaaagcaccaggattacaggcatgagccactgaaactggccccattctactttcttaggccactagtaacctagtgtgaggggagggtaagagagaaacagaggcaacaacaacgatgatggcaattactacattactgttactgactacaatcaacagcatttgaggagaactgagtatgtgccaagtactaagcatttcacatggaccgtcactcattggctaagtccagtcattattcttgtcttcagacagagaaactgaagtacccagccattaagaaatatgtgcaacagtgcactgtcaagctaggatgctacgtaattagaaatgaggactctggaattaggctaacaacattagtgacttagaatctttttggagaagggatctataagaaagtgttaacactggctacttttgcaaagaaggcctaggagttgacatggggggtagaagaaatttttcctttttctgtatttaaatctttctgtattatacgaagcaaaaaaaaaaaaaaaaaaaaaaaaaaaaaaaaaaaaagaccagtgtgtacataatattttagtaaacgaaaaacttatcagggctcatcttgtcattgagggtataggccttttaatttttattgttttctgtattagagcagccaaattaagatggagagagctcactttgtgcgtttggccacagtggatcatgctcagtgctcctggtgactttgtgggtttgcattttttccctctgaagatgaggctcagcgaggaacccagggcagacaatcccatttataccacagcaggttcctagatgttttgacgttggatacaaggtgataaactatcctggtttgcccaggactgacaggttttctaggacatgacacttccagtgcccaaactgggaaagtcctgggcaaacctggcggaattgctggtgctgcttggaatgggaaaaggtgacactcgatggagactccaacccacacagctccagtagcaaaagagcagagtcctagtaggctagtactcaggtggacaaggggattgccaaaccaaggacatgccttatctcctcggcattgcttgttttatacttagactctcaaagacagagcagactgaggaaataccatcaacaccaggcagggctgcatgtgactttcaagggcccaaggacctcacgtcttcataagccccttcctttatttaaaaaaaaacttaaaaattacactgaagactgcatttgtataaagaggaatataatccagtctgaatttattattatagatctattattattatgttcatttttcttcctttttttttttgagacgaggcctcactcggttatccaggctggagtgcagtagtgtgatcatggctcactgcagcctgaaccacctggactcaggtgatcctcctacctcagcctcccgagtagctgggaccacaagtgcatgccaccacacccagttaatttttgaattttttggtagagatggggtttcactatgtttcccaggctggtctcaaactcctgggctcaagcaatctgcccgccttggcctcccgaagtgctaggattacaggtgtgagctaccacacccggtcattcttccagttttaaaagaaattaaaatgaaaatgctttcataagcctttaaaagtatcatgggccctgggcattgtgtctgctgtacctataatgggcaagctggctctggttccaaagctcgaaagagaggctggggaaagaggaagtttggaagcatcaaggttgggggttcctaacttagataaacttgcatgggaaaaatgttctcaattttctacaatctctaactagaattaaacatttcattccattatgactgtaggcaaaaaaaccataactgcattgacagcacatgctactcggtcaccagtagaaatgactggtattttcagatcagagtggtacatgtctaaaacagcattttttctcatcctttcttcaaaattatggtagttattagactggctgctagatcatgctataggatgtattaccaaagaagttcatatgttattataattatgattttaaaatttaaatactgtgctttaatataattttttcttttatagttctgtatatgttgttttatgcatttcaaaagcttcaaggttttgaactgagaaggggtccccaggcttcagcagactggtgaaaagttcacacccaggaaatggtggagaaaaccacactaagtgtctagagttcataaatggggcccttcccttattttcatccctccaaatggtaaggaggagattcttacacagctctgcccatctgcaagaaaagcccaggatagggttaaagaattgctggtagagcttaaagtttcaccccaggtgtgcagcctaataaggtgctaattggaaaccaggtgagcagagggtggaagcccagatgcttgccttgggtgtttttttccttgaggcttggttgttgtcagaacagtatcaaccctcttccgggcggaaacaggctgagtgcctccctctgccatgcttctttgcagaaaattccactgttgtggtcctagggtaggcctggatttttagtttaatatgtctcatttacttacatttgttcttgagcactgagcacttcctgtgtgccacgcagtttgctcagtgctttaatgcattatctcattcaggcctcacaaccactccacggggaaggtattcttgttatttctatatttatatatgaggcaatagagggaggctcaatgcaacaagtgatttgcctaaatccacacaggcagcaagtggtgcgttgggatctgaacttgatctcattcttccaaaagtctctttcccttaaacttttggtttgcttgttgttttgttttcctttaacagaacttttttttcttgtagttttagttgacatgtaataattgtacatcgttaatgagaaactgagtgacattttgacacatgtataccatgtgtaatgatcaaatcagtgtagttagcaaatccacctcctcagtcatttatcatttctctgtgttgtgaacattcagaatcccctctcagctgggcatggtggctcacacctgtaatcccagcactttgggaggctgaggcagaaggatcacttgagtccaggagtttgagaccagcctgagcaacatggcgaaacctcatctctgccaaaaatacaaaaaattacctgggtgtggtggcgtgcacctgtagtcccagctactcaggagactgaggtgggaggattgcttgagcctgggaggtcaaggctgcagcgagccatgatcatgccactgcactgcagcctgggtgacagagtgagacccttctcaaacaaacaacccccccatcccctcttttagctatttgagaatatacagtaaattatagttaaccacattcactctatagtgctgtaggacaccaggactcatttctccttctagttgtaattttgtatctgttaacccacccttcaacagaactcttaattttaaggatgtagcacatctcagacacttcagctgataggcagttatcacgagcttataaagaaggggcttaatagaagataaaatgtgactacaccaacatggtggggccctagaattccaagcctcctggagtggaggacggtcttcctcctcatactcaagctttgttgctctgtgataatcataaaggctgacattaagcaggtcttatgtgtgttttggtggggtgctgaggtgaagagaaaaaaactatcctcttgaggtaaaggtcatgaaactccaacacatatatccttgaatttttaattaaaaagttaagagaaaaaaagtcacttctcttttccctgttactgcttggttacattccagtcttccacttatggaactttgagagaagtagctggttttaatgtgggacaccataggttgggtgggtttgccatcagaattgctctatgctgggtctggggtcagcttctctccatcttatcttcaaccacccagaaaggtcaatgctcagatgcaacgactcctcaagacacctaccctttgtcaccatctgtttatatcccaaggaaagatttgatgttgcaaaatcctgaaatttagagcaagcagagcaaggaacaatccattccttgttttaaatcaagttgtcataatccaaaggcaagctccaactttaataacaaacacccagtgttatgacattttaccttttccaactatttatgtaggcccaaatattgtgtttaaatttcaaactatacagttaacataaaacagtccactttcttaaatacagtaaaaataaagctagtgatgccaatttcgtttcccttttaggcctcattctttaaatagatcattcattcaacgaatgtctgttgaatgctcagtgtcagacaccgtgcttggcacagcatacccccaaattaaccagcattagttcttgtgctctgagcaccatagagaaacaggaagaaaacaatggcagccgctcttcaaatgacctacgcttttccatctccaatgtccaaagaagtatcagagatgatctgcatttccttttcagtcctctccaagccctgtcctcccaaaccaagtcataatgagatctaaaagctgcagggtctcaaacatcacgagagtaaagcccaaatcacatttggagtatggtttttcagcagttttatgaactcaggctgtgaaatgcaggaatgaaagtggtggagaaaacagtatttttcagtgacccaaagaaagatgaaacgtatgatgctctgtggacttggcatccctactcctcatcccactctcagatggcaattggattttaacaaggagtagggtttgtggtttgagaaatacagcatttttactgccttgggtcatatttcaaatatttgcagccgtttaaaatagcgtaatgttattttttcccttgtcttcaaaacaaacccagcaagcttttctaagtcataataacaagcataaaattgggacactggaaaacccatgggcagggctttggaaaatccattctccctcaggacgggtgtttagatttggttgcaaaggatcattagcttcctggaggcccacctgaccttgaatgactttgggaccctgaaggaaggagtaaggactccacaggccacagaattgggatgtcccacccaactgctcttcagtgcaatgatagaagtgtgcacagaggctttgggactttccttttagctaagatgtcctgttctggaaattgctttgaaaaaaaatccagagactcatatttatttaagtgagcaattcccaatacccattggtttggagttctgtcctgtgagccacgctatatggggcttatccctgccaaagggcctcaggtggggtcaaacattgaaacaaagaagtgaactggcctcagatgcaagggttcccagctttccctttattagaaaaatgaaagataatcaatctttgccgagaaagaaatacacacacacacacacacacacccgtgtgtgtgtgtgtgtgtgtgtgtgtgtgtgtatatatatatatatatatatatatgtatatgcacacttacgtaccagacaatgatgtttggtcaacatggaccacatgtatggtggtggtcccataagattataacaccataattttggtgtaccgtttctgtatttagatatattcagatacacaaatgcttaccattgtgttacagttgcttatagtattcaagacagtagcatgatctacaggtttgtagctaggagcagtaggctatgccatatagcttcagtgtgtagcaggctataccgtccaggttggtgccgtaagtgcatcctagaatgttcacacaatagcaaaactgctttgaccaagacatatccctgttgttaagcaatgcatggatgtacattaatccgtgcattaatatacagtaaatatatagtaatatagtacacataaaagttaatatttcttgagcatctcctagtccataccccaattaatcctcataacaatcctatcaaatgtgtactattagtattccaatttcttgatggagaaaaccgatgtgtagggggataaagcaacttgcccaaggtcacacagccaggaggcaggggagctggggtttccatcctggcagctgcctgcggagaaggagagagttctactgtgtgttaccattacgcaccctggcttgtgaggtccagatttagatacattcatatttcaggtatcagaacttctaaaaacctgatgacgaaagaaagtgtttgaggactttccttttgattcttattattaaagaaaagataaatgcaattctccaattatatggaagatatgagaaaacaaatcaaagtgaattaaaacacattttcccaggccaggcatgggggcttccacctgtaatcccagcactttgggaggctgaggctggcggatcacttcaggccaggagttcaagaccagcctggccaatatggcgaaaacctgtttctactaaatatttttaaaaaataataataattagctgggcttggtggcacatgcctgtaatcccagctactagggaagtggaggcacgagaatcacttgaacccgggaggtgacgttgcagtgagccaagatcgtgctacttgcactccagcctgggcgacagaaccacactctgtctcaaaacaaaacagaacaaaaacaaacacaaacaaaaattccaacacattttccctattttaacacctctatatcctctcccaaagagcaaaagaataaagaaaaagaagaagaaaagtcctttatttgtttctactttttgaaattaccttttccaatttttaaattcctggtttgaagaatgtaagaaaaagaaacgacaaaaacttcttctgaagccgaggaggaagccactgcgctcagcaggcctggaactgatgggggccaatctgtccgggtctgggctggagtgtgggagaatcctctttgcagggaggacacgggaacgctttcagcgttctgggataaaagacttcagaagaaaggcgcctctcaatgaatggtgctcaaaatgggctggaaaacaggggaaacgggccctctcaatgaaaagccgaaaaagtgccttttttgttgcttccctcactgtgaggcactgctcttcccccatcatcctccctgaccccttccccagctcatctcattgggtccagagaaaaggcctcttgttgtaaccccatctgcctgccactcatccacattcttttatctctgcccagggcctggcagttgggctgaggtttcagctgccaaaaattttgggtttcacatagaatattcccaagatgggcatctgagaaatgtcagtttacatcaaaattgccttgtccaacgaatagccagaaagctttctttccctagcaaggtcgggaaataattctccttccaagatcatgccagtacaaactcagatccactctctgcaaggcctgacttaaagggacaggaaaccaccttggttttacactaaaaaaaaggattgaaatttaaagttggattaaagatggaaaattagtcatgtttccttttttgacggtgctttgcgcaacaatgaatatcgcactataacaaattcttgagaacaggagctgtagacaaggtcacagaggaaagttttggggatgttaaaaaaatcaccaatccggccgggtgcggtggctcacgcctgtaatcccagcactttgggaggccgaggcgggcggatcacgaggtcagaagatcgagaccatcctggctaacacggcgaaacccccgtctctactaaaaatacaaaaaattagccgggcgcggtggcgggcgcctatagtcccacctactcgggaggctgaggcaggagaatggcgtgaacccaggaggcggagcttgcagtgagcccagatagcgccactgcagtccggcctgggagaaagagcgagactccgtctgaaaaacaaaaacaaaaacaaatacaaaacaaaacaaaaatcaccaatccataacaacttgtgtagttggcaaaatcaaatggatggtggggtgaggatgaagataaaaggataaagaagagaaagcagaatttcttagagacattttactgatccataggaagttctgtaacaaagggagcagagcattctttgaagtggaagattgggccactcgactgagttggttagaatgtacaggagggaaactgcgagaaagtctggttttctaaccctgcagggaatctctgctcataatgatcatttcaagcattggtacattcatcccaaagataacactagattctaactgctatgcagaggaaaattcaagcataaggatgggtggaggggtgtccagatagaagactgacaggctttttagccccaggtctgaataggagcaagtcagcagaagcaataaaggatagaaaccctgttttctactcacccccttccagggttgtcctttgttaggctgattgttatgagagtggaagtgggaggtggcagggtaggagttgggagaggtggggttgggatgtgggaaggtagggggctgccagagggtttggggttggggtagagtttggcccatagattcccacaggtggtgaaggcctggcagcctctctccatcccttacccacctcaccccccctttttttcctctccctgtggagaataagcaagtatcttctggtcagcttattttccctttcagcagtagctctaaccccggaggcagagaggtctttctaaagtaaaaatgagaacctaacagtctagctgaagatcctgcaatgctgcccatcatcccaaggtaacctacattcctccccatggcccaaatgtggggtgactcttgaaacgatcaaccaaaggacttttttaaaatttttttaaaaattactttattgaagtatggttaaaggacatatttgaaagtgaagatgggtgcagggaaatcatgctagggcaacatcactgacccaaaaggcccttggagacctggcccctgcctctctcctcagcctcttctgatctcccactttcctctgctctctctgtggctttgatgctggattccttttgtctctcgtgccctgtcccacttcagggccttcacgcactccagtctctctgcctggcttactcccctttatccatctctcctggctactgtctgtgggtctctcctagagtccctgctctatctggggaagccctctgtgttgtgttttgtttattttattttattttgctaacagaaagaaagcagggatcagattttaatatcagacaaaaatgaatggaaggcctaaagcacacaggctatggcttgctgtgagaatgtctttgcctccactgcatcttcaccaacttgttcttgttcttcctatctcttccctaagtctttccaactcatctgctcttatcatttctccaggatccaaatgcctaaagggagcatcctctttaaatccccagccaggcccagtcagccttcgtctggggtttccttctgcttcctggcttatacctttttaggagggctgagacttctttctgcctcctgggggacacctttccaaggatggactccctcagcctttggcatgttctgtggattttcttcattttcttcacaagtcttgtgcattttgagtattttttattatttcctttttagaataaattgatcttgaaaggatccaggtcacttttatccttccccagcaatagggagtggctacagggaaataggccctggaccataaaccctgtgtgttttatggtctcaaggaccaggggtgatagtccaaagatgcagtcactgctgcgtaatatgaacaaataaatgaatgagcaaatggatgaatgaaagagcaataatttccctttggcttggtcagcttgggctgccatataggctgtgtggcttaagcaacagacattttttctctcatagttctaaagactggagtctgagatccagcaccagcatagttggattctggtgagggccgtcttgatatatcctcacatgacaaagagaaagagagaggaaggagagggaatatctctggtgtctcttcttgtaagggcactaattccatcacaagggcccaatcctcctgacctcatctgaacccaattacctcccaaaggccctatctccaaatactgtcatacttggggctagggcttcaatgtatgaagttttgggaggacacaattctgtctagagcaccctttaattctaaataaatgaaacaatatgtggaacaaatctgcttactgagtaatatattgcagcataaattgttcatcaggtcattcccataatttccaaattactttttaaaactattttaaaatttccatatattttaaaactgtttaaaactaccttgaaaactatttatttatttatttatttatttatttttgagacggagtcttgctctgtcacccaggctggagtgcagtggcgtgatctcggctcattgcaacttccgcctcccaggttcaagcaattctctgcttcagcctccccagtagctgagattacaggtgcctaccaccatgcccggctaatattttgtatttttactagaaacggggtttcaccatcttggctaggttggtcttgaacccctgacctcaggtgatccacccatctcggcctctcaaagtgctgggattacaggcatgagccaccgtgcccagcaaaactatttattttaaaataattactgattcacagcaagttgcaaaaataaaacagaggccctgtgtacccatcacctagtttcctccagtggaaacattttacaaaactactgttcgatatgaaaccaggacagcagtattggtataatccacagaccttatttggattttggcagttttacatgcactttacatttgtatattgtgtgtgtgcatgtacttctatgcaattatacaatatgtgtagatttgtgcatccagcaccacaatcaagacacaggactgctctgtcaccacaaagatctgttgtgcaactctttttttttttgagatggagtatctctgtcgcccaggctggaatgcaatggcacgatcttagctcactgcaacctcggcctcccaagttcaagagattctcctgcctcagcctcccgagtagttggaattacaggcatccaccagcatgccctactaatttttgtgtttttagtagagacagggttttaccatgttggccaggctgatctcaacctcctgacctcaagtgagccgcctgcctcagcctcccaaagttttgggattataggcatgagccactgcacctggtctatccagtctactactgatgggcttttaggctgattccatgtctttgctattgtgaatagtgctgcaataaacatatgtgtgggtgtgtctttacggtagaactatttagtaaattttttcttttaaacatgtatcagcatgtgcctttatgatagaactatttaataacatttttcttttaaatatgtatcacatttaaagtggtgttcaggccaggcatggtggctcatgcctgtaatcccagcactttgggaggccagggtaggaggattgcttgaggccaggagtttgagattagcctgagcaacatagtgagatcctgtctctacaaaaattaaaaaaaatatatatatatatatagccagtgtggcagcgcatgcctgtagtcctaaatactcatgagggtgaggtgggaagattgcttgagtccaggagatcgaggctgcagggaggtctgattgtgccactgcactctagcctgggtgacagactgagacctgcctaaaagagtaaaaataaagaaagtggtgttcaatttctgtcctttaatctccttgcagtcagggcccttcctgtacttgtcctttctccagcacctagctcagtgccagcacagagtaggcactcaaagcacttttgctggatgaaggagtaagtgggatcctgttttgtggatggcttgttggacctaaactgatttctcttaagaagaaactattcattcctttcctaaatgatgcatttcccctcaggttctaatggatttttattttttaatcaaggaagaagggaatgaatgtgctagcagctgctagtctaagcagccgctagcctaagcagcctgattatggtgttcacagtgtctcctccccccttactattttgaagtaagcacaggaaattacataaattggcaataagagtccagcagttgggatcggggaggtatgcatatttgcatatccagttttctggtcccctaccaagagaacacatggagctttgaccttccatatgtttttaatgcgtgttggagataagtgttccaacaagttggaagcaacaggttgagttttctgcatccccccttcttccatctgaagctgcttcaagcaggctgtgcatgtgtgggagagacaaaacaacctcccatggcactaggccttctcagaatgttgtggactcctaccctcttgaattgtttaatctggaaatcttccctgacttgcagggctggattaggtacaacctcttgcccctagcaccctgtgtttatcttgcaaggcacagacgatgctgtcctggaattgactgtgttctggtctgtcacccacattagactgtaaacctgggaagattagggccctgtctttcttctctaccttgttcccggtgcctggcatcatgcctgacccagagttggggctgaggacgtatttgttagatgaatgaagacatgactagaagggaaatatgagcattaatcagagctttctgacagtcaacaagtcatccagacttctgacacccatacattctggttcttattgcaagaatcaccaaagactatggttgttcatcctataattcagtggttctcaaatttgaacactcactggaatcacctggaggacttgctaaactataaatcgatgggacttattcccagagtttctgattcagcttatctgggctggggctctagatctgcatttcttttttttttttttttttttttgagatggagttttgttctttcacccaggctggagtgcagtggcacgatcttggctcattgcaacctctgccttctgatttcaagcaattctcctgcctcagcctcccgaatagctgggattagaggcacctgccaccatgtctggctaatttttgcatttttagtagagacggggtttcaccatgttggccaggctggtctcgaactcctgacctcaagtgatccacccacctcggcctcccaaagtgctgggattacaggcgtcagccactgcacctggccttagagctgcatttctaacatgtttattggtaataccgatgctgctcttctgggaccaccattcgagaacgactttaataataaatagagaaattatgctcaaattacatttccttcaacactgaaatctgcatcgcataatttaaaaaaaatggcaacatcaccgcttatgatgtaaaattagcattattaatttaaatgtgatttaaagagcacaggaatctgtaactttgactttgtgatagatgactatgctgggcttttcatccacgtgaattccatatttaaaaggcaagtggccattcccggtggctcacgcctgtaatcccagcactttgggaggccaaggtgggcagatcacttgaagccaggagtttgagaccatcctggccaacatggtgaaaccccatcactactaaaaatacaaaagttagctgagtggggtggtgcacacctataatcgcagctactcgggaggctgaggcatgagaattgcttgaacctggtgggtggaggttgtagtgagctgagattgcgccactgcactctagtctgggttacagagcgagactgtctcaaaaaataaaaaataagaataaaaaaataaaaggcatgtggaagaaagatcatggggtttggagccagcaagacctggctttgattctcacgttaccacttactgcccaggagaccttgggcaagttacttgcttacttagggtatcagaatcttcatctataagatgagcatagtaaaagactcttttcagttgctagaagaaacaggaaaaacaaacaagtatcccttcctagccaaagacaaattggatcttgagactaaaaacattaagtttgtctagcaaggaatatagtgttttctgaagctattcagctcctgagtttagataatgagaattattttggaaaattcatctcaacttactgggttactcagtgtgcatagtaagaatttggaaacagggatgtttacataagtaaaatgactttttttttttaacagagtagatgctcaataaatgatagatataacagaaaaactgaatgccagagaataatgtatgcataaaatagatggataaattatacagggaagatcttcattacctgagaatttgttatttgagagcctataggtacccagttgtggagggaagctaagattacagtaacacaggaaatattcaccaatgatatgatcaccaaaaattggttcctactcaaattcttcctggctcagcatcttttttgctcattatgttacagttttagttgtttctcctctcttgttgcccattggatgtccaccgagcaaacaggcaaacccaataaaaagcttcttgaaagtgaacagcaaatcttacaaatgcacaagatttcctaaagtcgatgaaaagatgttagagaattacgcagagttacgtagaaacagggttctagcagaagagcagcttacaactgaagaacagaaaatccagaaggatgatgttataatggcttcaaaagataattatttgactatccaaggattgacagagaccttgagaaaagcaataaggccctcaaatagtttttcacaattggttctcttttgataaaactacaggtgtcaataggaagggattatgttatattatgttatcatgattgtaaacacacaaaatgttatcatatattttgtcagacatattatgttaaaactacatgattcttgcttctcctaacaattggtataaattacattataatctaaataagcagttagcaaactacagcttgagggccaaatctggccaccatctgcttttataaataaatctttattggaacacagctatgcccattcgtttacttattatttgaggctgcttatataccacaatgacagacttgagtagttgcagcagaggcctcatggcccacaaagtgaaaaatatttgctatctggcccttccagaaaaagtttggtgacagttattctatctagcccttccagtaaagtttgctgaaaattgacctaagattctttttttaaataagctttttctatttttacttttattttaaaagatacagttctaataaaaataattccttccacttttacattgacgttttaatttccattttaagtggatttattttaggtggatacctttattttaccactccccaaattatgtttagctgatgaggcctccttataattgaggacaaaacatgactattcataatgataaattattgctgacccccaatttagaagtgcaagactttcaaatcagactgactatgtttgaatcctgatactgcttgctacttactagctgggagtatccatgcatggcatctaatctttctggatctcagttttctcctccctcatgtggggatagtagcatgaactctgttcagttagtgaactaaaacaagataatgaaggtcaggctcttaccccaatccctggcacaccgtatacacactcagtggcagctgttgtcatgtctatctgcctggagtggtttggaattgccatttacacaccctgggatctgagtgctgtgtttctccaggctttttgtgaattgtttgatgtaaggcaacactacagtttggaaggcactgctgggagtggaggcaaatccttcaccaaatcaactagtccactttgtttaaaaaagtaaaggaccagttcagaatttatcttcacgtttaaagatgtttcctttagtcagtgcatgtcagaaattgctgcagcagcagcagcggggaggaagcctctcacaacaatccgactccagcagggagagtcagcccaacacgtcttgcatctaaatattcccagatgctgtaactgcaagagggaggcattttgtttttaggagaagtggacaaaaatgacagccacaaggcagtgatggtaatgagggtggtagccagcaggccaggggagagcaaggtgatttcctggctgggtcacgctgaggaacaatacaggctttattcctcccggccttgtcctggtttgcaaaatacttgcaggagcagcccccgttaagcttccaagttgctccccaatgatcccatctttttgtatttatgcctttgtgtatgccctgtccctgagtatgggctggtcctagcaacttgcttctaaccaacagaaatggtaaaggtgataagatatgatttctctaactaggttataaaaatctttaacctccatcttgctagcagacactctctattgccttctcagcttgcacattttatgaaacaaattgctatgtgggagacaaccacatgccaaggaactgagggtggctgtgggccaatagccaacaaggaactgagggcctcaatgaactggatcctaccaactgtcatgtgagtgagtacagaagaagatccttccccagtggagccttcaggtgaaaccccagtcctgactgacatcttgattatagcctgtgagagaccatggagcagaggacccagctaagctgtgcccagagtcctgacccacagaaactgacctaataaatgtgtgttgttttaagccactaagttttgggataagttgttgtgcagcaatagagagctaatatagatttctcccttaaaattaaaaagcagacaaaagacctacatttctgctgagggttgatgggtggactgtcacttatttgggtttatttcagtcattcttcatctaacatggcgtggtattaagaacagcacactgccgacaatgctgatagattcatttggctaagccacacctctgatatcacccttccccaatttaaaaactttcattggttcccactgactgaatgaaagaagctcaacttttttgccctctataaactgttaaaatgatcatcctaaaatatcagttagcctgttactcttgtgcttataaaagtctgttcaattctggctgccaactaggttaaatctgtgttccacaacatcaagtcctgccatgacctggcccctcatacctttctgtcttacatttttctttttcttttcttttcttttttttttttttttgagacaaggtcttgctctgtcgctcaggctacagtgtagtggcatgatcatggctcactgcaacctcaaactcctgggctcaagcgatactctcatctcagcctcctgagtggctgaggccacaggtatatgccactatatctggctaagttttaaaatattttgtagagatggggtcttgttatgttgcccaggggtcttgaattcctaggctcaaatcctcctgccttggcctccaaaagtgctgagattacaggcatgatccactgtgcctggcctctgcttcatgcttagtgtctcagcaacacaggacagcttgtcatatgctccccaacacacatattgtgccatctcctgccctccccacttcccatctttacgacatctttccctttgcctcaactgctattctattcttttcattctccatattcccttctctggaaaattcattcttaaagttcagctctgatcatctgagtaataattagaaaacatactcatctgcttggatctgcatagactgtctccagaagaatccagaacaactcggtgacattggttatctctggggagggagtattgagtaggcctgagggatacactttaagagagggaaactttactgtaaaccattttgtgcctgttaaattttgtagcatatgaatatatttctctgttcaattaaatattaaatgaagcatttataatgaaggaaaaagttaatttctaaatttacctttgctgggaagccttccctgactttctcttaccgagttgattgtgtgaagtcctgttcatgtatctgtcaccccctccagtctctactgtcctagaattcagggattgctccttattcctcccttatccttgtccctagtggtctagcacagtgcctgctacttcataagccctcaaaatagctgaggaataaaacaactacacttgcaaatgtatttcccaccacctctcagactcctctatggtcactggccatttctgcctctggggctagctcctactgtcccctctccttggatttccctttcccccattattttgtttttgaagtctcctcatttttcaagactcaactcagctttcaccccaggaagtcatcttctccctgtctgctttcccatacactcctgaagaatttttttttgagacggagtttcagtattgttgcccaggctggagtgcaatggcacaatctcgactcactgcagcctccacttcccaggttccagcgattctcctgcctcagcctcccgtgtagttgggactgcaggcgcctgccaccacacctggctaattttttttttttttttttaagtagagatggggtttcaccatgttggccaggctggtctcgaactcctggcctcaggtgatccgcctgccttgggctcccaaagtgctgggactacaggtgtaagccaccacgcccagccactcctgaagacttttctttatcctttatataaggggctggtgaactatggcccgtggccaaatctgatccattgcctgtctctgtagatgaagacaacttttatttatttatttatttattcatttatttatagatagatagggtctcactccgatgcccagactggagtgtagtggtgcaatctctgtccactgcagccttgacttcctgggctcaggcgatcctcccacatcagccgctcaagtagctggggctacagatgtgcaccaccacttccagctaatcttttgtatttttagtagaggcaggtttcaccatgttgcctaggttggtcatgaactcctggactcaagcgatacctgcctcggtctcccaaagtgctaagattacaggcgtgagtcactgtgcccagccgacacccattctttcacacatcatctatggctgccttctccttccaatggcagagttgagcattgcaatggagaccctcaggcctgcaaagccaaatgtattatttatctggattgttacagaaaaagtttgctctctcctgatttatatcataattatacctatttactattctgctcattaagatacaaacttggactcaaactctgtgttgaatccagtcaaagtcactatcctggcaaaagaagctgcccacccctcctgagaacctccgaatgccaccacacagagcatcttcccattcccagagccattcgcatcctttcctgcttcagctttgagcttgcggtctgtctccgcctgaactcagctctctcaggatggttttttcttgtcctcctagtcacaccccaactccccaacctagagaggcattccctgacccccttacctatttaggtactggtgctagtttctgttctgacacctgtgtatccctgcatgacacatactacaagctgtaattatttttatttatctgtttggctctctctctcttactagaccgtgagttccttgaaggcaggaacgttatctatctagtttcctactgtatttgcagtgtctttttttttttttttttttttttgagacagggtcttgctctgtcacccaaactgtagtgcagtggtgccatcacagctcttgatttgcagtgtctctcacagtgtctgtcacaaagagggtaaatactataggaaatactatttactgactaaacagatgacagactgactaaatctttgtctccatcagagtgactagctgagtgtctaacaggcactcaacactatttgttgaatgaatgaataatgtaagaggggacacttaatcatgacaatactgataaatgaaagtaactcattgcagagttctctccaccctttaatatcaagctcatggaaaagaatagcctccttcagctccatttaaattattcaggacaaaggaaaggaagtaggctctcaagggagatgctagaatatcctctgattgtgtgtgtgtgtctatgtgtgtgtgtgagtgtgtgagacagaaagagagagagccagagagagagagagacagacagagagagagagagagagagagagagaaatatgtattagcctgcaggtcgggctgctgtccatggacttggggaataagggaatgcactagttctatggggctttgcacaaatacgctgccagtggactgtgaaatctgtttttccttagaatcagcagttcagaagttggaatatctacttaatgtgttttttaaagcaatactgttttggattataaaattgatgaacgcattgcaaagaatttaaaaactaaagaaaatataaataagaaaataaaaattacccttaatttcaccgggtattttgtcttacctatacgtattttagattttcttcctctctccttccctctcccttcccctccctccttttctccctccctctcttccttcattcatttcttctttttttccgatacatttgagacctatttagcattatatcctgaacattatctcataacattaatttttttcaacaataacattttaaagaactatataatattccagaaatttactccaggaaatttattcaatcccccatatgagttgttttctattttttggtgttatcactctataattaactaatgcacagttctacagtggacagatttggtagttttgcctttcttttaactagatttatagaagtagaattattggctaaaaatataaaattttacattattgtttacaggtatggccaaattaattctgtgggactgatatagatccacagtcctagcctcatgcctattttaccatagactttcttcaatattattacattgctattgatacagaagggggacagagaagtgctgggtagaggaggacatggtccctggctagggctacacccgcaagcctatgcccatggatctaggtgaagacaggcatttttgtttccctgctcaaatgtttcatttctcaagaccaccctggcctgccatgcccccatcctgggcctatagaaaccctgagaccctagcaggcagatacacaggtggctggacgttgagaggatcagaagagtggaggaacagggatgggggttggctggatgttgagaggaacacaccagcgtaggagcacacgggcacgccagcaggtcatcaacgggtggaaggaggcaaagtttggccagggcagttagaggagagcccagactgctgagtggcctgactccaggggaaaaccatctcccttctggctccccgatctggtgagagctacctccactcaataaaaccttgcactcattctccaagcccatgtgtgatccgattcttctggtacaccaagacaagaaccctgggatacagaaagccctctgtccttgtgataaggcaggggtctaattgagctaactaacacaaactgcctatggacagctaaactacaagagctccctgtaacacacgccctggggcttcagctataaacattcacccctagacactgccgaggggtcggagacccacagcctgcccatctgtatgctcccctagaggtttgagcaggaggggcattgaagaagcaagccacacccccatcacatgccgtgtgagggggacaagggaaactttccagtttcactatcacataatacttatttttaatgagaaagcatcagttaaaatgtttattattaaatctcttttcctataaacctattttccctatccacattcttctttggagcttaagtactttaaaattcaatcaaacttaaataataattgatatcttctaggtggttgattatgcttccaactaaaagtaatatttaagtatagtatttagagtcatttgatataataacagctcgcttaaccatgagccaatttactgactcttttttaacttttcagaatactaaataccagagagaaatagaaagaaatgcatttttaaaggctaaatcatggtcaaagatcagctaaatgtatggtacatggacaaatcccaacaaaatcatctggcaggggttgtgctttgggtgttcattaaaagcacctcttcctgggccttacccaacacccaccaagtcagaataccttgttgtcaaggtataggaatctgcatttaaaaaatttttttatttcaattggtttttgtggaacaggtggtgtttggttacatggataagttctttagtggtgatttgtgagattttgttgcactcacaacccaggccgtgtacactgtacccaacatgtagtctttcatccctcaccccatcctaccctttcccctgagtccccaaagtccattgtatcattcttatgcctttgcatcctcatatcttagctcccacttatgagtgagaacacatgatgtttggtttttcattcctgagttacttcagttagaataatggtctccaattccatccaggttgctgtgaatgccattattttgttcctttttaaggctgagtagtaaggaatctgcattttactaaggcttgtggaattcagaaatcactgctgactttcctcttcatgctgagtctatttattcttgctttacccagaatctactgggcctcgataaggtgtgcatatccctaaccagatggccctcattcaaacagaattatggtgaaggggacttgccactagggcatattttccctctttggacgtgagatcttgactatcatcagagaggggccatgtgttctaggaatctaagtgtaataaatatgatacccaaaggacgatctttaccttgataatttatgaagatgatcctgattcctttactgccagtgggcaaggctggtcttcgccttgggggatgaagtgacactgaggatagggcagaggagaccctggatggcaagcaaaggtctgctgtagaaaacagaaggtacccacagaaattctgtgaagtaatgcatacaaaagaaaagtatctgccaggcacagtggctcacgcctgtaatcacagcactttgggaggccaaggcaggcagatcacttgaggtcaggagttggagaccagcctggccaacatggagaaaccccgtttctactaaaaatacaaaaattagctgggcatggtggcaagtgcctgtaatcacagctgctcgggaggcggaggcacaagaatcgcttgaacccgagaggtggaggttgcagtaggccaagatcatgccactgcactccagcctgggtgacagagtgagactgtgtctcaaaaaaaaagccttccttttggctggaaccaccatcttccagtaattcgccaaaatgatgaacacaaagagaaagagaagaggcactgatatatgttctccaggccttttagagaacatggaattgttcctttggccacatagatgtgaatctataagaaagatgatattgtagacaccaaaggaatgggtactgttcaaaaaggaatgccccataagtgttaccatggcaaaaccggaagagtctacaatgttacccagaatgctgttggcattgttgtaaataaacaagttaaggggaagattcttgccaagaaaaagagagaagccaaagagaaagtacctgggttcaactgtgcctgcctgctccacctagagaagcatgctttgtaaaaaccattgggaaggagcctgagctgctggcacctagtccctatgaattgatggcacgataggtgttaaaataaaagacctctggactgtaaaaaatgtgtctctttttttcagtagagtgtggtgtcccgtcccccaaagaaatttttaaagcaaaaaaaaaaaaaaaaaaggtatctttttaaagcaatgttcttcaaatgttgttcattgcccttaaaatgtttttgaaaaattatttactccttacatattttaaagttgagaactaaaatatttcatcataaggttaacaagttgtataaaagctggataatttctagcaaactttgatgctgtaaaatgaaaatggtttgattaactcttttagcttcaactagtggaaattaaatatcctagggatttgatatgtcagtccttttcctgtttccattctacttcctgcacagactttactatagtatattttaatgcttgaaaggtttcttattggtcactgtcacacttgcctgaatcaagatattataaagttaatatttaaatttttaatattttctgtgagtttgctattctagatgttaaaaatttcttctctgttaccattacaactattatttgtactaatttgctgaaaacaacaaatgtattatttgtagataattgtgaaactagactataataaaactttattggaagtgcatatcttttttttttttttttaataggcatggggtctcactatgttgcccaggctggtcttgaacacctgggttcaagtgatcctcccccccttggcctcctacagtgctgggattataggtgtgagccaccaacgccaggctgtaattgcatatcttaaatgagatggatggggcttttccctcccttcccattaacttctaaatatgttttactttccaaaagagacagggttcagcatcaattttatttcttttctttgcttttaatcatagctgtaaggactgaaaaattttgtccacattagtagatgggaatggaaagagatttattatagcaacatcactcaattctttcaaattatttgccaaaaattatgtggtgatctatcatcaaaaatatttttaatgctctaccagctgacaactccatcagatcctcattcaattttgttgaaagcaaagaattgaaaaccggttgacttacaaaaggatttgtaacccaatcattagaatgtttcactttctcaacactgaaacagctagattttgaatcactcctttgttgggagacctgtttttttttttttttttctttttcctggggcaatacaccacaacgagattcaggatgagttagaggtgggcgtttcttttgtaaaaggggaaaaggtagttgtgaaaggggaagtggcagaggacccgctgaagcctaccacacaaccgaaggatcatcatctttaatgttgtgtctctgcatgtcctgaaggaggtgctcaggccccttgaggccttggaaggagaactcgcatgtcgcagtcatgctctcagacatagcagttttaggagtacctaaagaggagctgataatctggaaattattcctttaaaccattcatgccaaagtcactcttaaaaatcttggcagcaactatcaaagaaataacagattcaggtgagaatcatcaacaagggctagaactctaatgaggaataagataattacagagcctcaaattatctccccacaaaatattagtgaattacccattaagtactaagtaaaaaatacttagaaataaactttacattgaagaacacacacatacatatagaagaagtatatatatatatatatcaggaaatcccccaatctgagacagagataaaacagaaacaaaaagacagtccatggtgtctgatatccatctccagtatttttcattgagtaaaacattgatgactcttgttcagtgtagccaagggaataatctctgtcctggtcaggactggattcttcttgcatatcttcaaccataatatgatctggtttctcttgtattctgtgatgtgcatttcctgattcatggcctttactgtaaaatatttgtctttatcaattgatttctgctgcagactttgctttgctcccattgacttggaaaatgatggatatagttgtaccatgctgtagttctgttttcaactagagtcctctgtttctgtccagattccttacctaaatgttttccctatggcaatgatttggaattgttactgtttaaataaaagaaggcaaattggttttatatcaccaactgatcagtaacagacctcttggggtcctctgctaggtaagattttgatgccctttctgggcttaatgggaaagagtgccatgattgtttagtgatgtttgctacagcctctagaagaaagacaatgatacatgcttggtgtgtggagtaagcagcctctgcaatggttcacagtgatctccttcctagtattcatctccatgggggcgggccataatgacttgcttggaataaaaaaatgtggcaaaggtgatggaatgtcacttctgtggttaggttacaaaagattgtgacttccatcttgctgcagatgttctttctgctggctttgatgaagaaagctgccatgctgaagaggctcatgtaacaaggaactgagagtggcctccaggcaacagccagcaaagaactgaagctctccacccaacagcccttgaggaatggtatcctgccttcaggcgagactctagcacttcattgcacacagccatgtcagagaccaaagaccctaaggtagagcttccaacaaagtgcgctggatttctgtggattcctgatgcacagaaactgtgcaaaaataattatgcattgttttaagctgataagttttggaggtaatttgttaatgcagcagtgggtaactaatacgtcatgtatttaccaattttagtttaatcactttatgtactttattgtgtagccgaaaaatagtaggagcagcatcatacacatagcaagcagcaagaatatagctgaatttaaaagaaataatccacaaattaccaagatcaatcacaaggatgcaagacacggcaatcagaggttatttagtggagaggcaaaccgttttggagaactcaaacaactttgaattcaactgttttgccattcagttcaatgtagctcataatagtctctacttctcttatcctagcacttagttcagtgggattccttgtttaattatctctcttcttcaccagaacacaggtttaataaggacagggtctctgtctctttcaatcaccattatagtgctcatacctggcatagttcttggcacatattagccttccactaagcatttgttgaatgaatagacgttagtgtttcagtgaatgtcaataagtcacaaaatattgctatacattttagaaaaataagcacaagaaatagttataataaatattttcttagcgcttacaggaagtaagtcttagtatctggccagttcactcatttagggcatctaattccctgacaatgccagttaaatggaacattactgtaataggtaccattaattattcattgcaaacacagtgtgcaaggtcaaatgaaatctgatggaaaatctcaccattgtggaaaaatcacttgctgattattatcacaacttttactgctgcagaatagagcttatctccttccagtgtgttctatggggaccatagccactaagttcatctcaaggaaagtaaggcaattttattttatctgattgcacatttctctgctgctaggaatttctttaatcttgtaaattatatacataatatatatgctttataagattacagaaatttaatctttatgttatatattacatatattttttacaagattaaggaaattttatgagtaaggaaatctaatatataatttacatattatatatatgttaggattaaagaaatttaataaatttcctttatatatataatttataagattaaggaagtttataagattaaggacttatatacatatgaactattataaacagagagaaggaaataagttatggtaagacagaagcagaataaatgaaaaacagattatttgtgaaagagaaatagaacgccggtgtcaccaaattttagaggtctacccctgaactgcctagagtaagctaaccaacataaaacccagaacctacatcaaggggatgagtttagcatttgtttgatggcaaaatgggaaatggtggtgacgtctttattcagtgagaatgagaaacggtatttaggtttctcttgttgctctgtgtcgagaaggattctgaggcccagtggaggatcattatgattgattaaagatggcaccgagtaatggagcagatgtactaatcagtgcatttgtgagtcttagatttctctgatataatacaattagtttcagggtaaattgcgactcagtgaaatccaattacgatttattttccttattgcaataatatgaacagacctgtttctagattcaaggattttatttttttaaacctctgcacttctagcctaggcttggcttatatttactttcaacaggttatttcagcttagggaaggatttcaggctctgaaatgttatcaagtttcccaatagtgaaaaacaaagctcataaaaatgaatcatttttcaaaggtgacagaaaccactgatgcctctggcttatgtgtttgcatttcaccataaagcaataactatatgtccactggtgatttgctttaatcttaagataaataaaacctgttggagcggaaactgagaatagggtggtcaaagggtaaacggtatcgctagtactttgttctgacattgctcatgatttcttggggcgtttagccattcactaacctaaactagtgcactaagccttttaaaaaataaaaatgtatattaagagacacaactgatctggaaacactttacaaaatgaatattaaacttgtaacatgcagatgacattgcatagagatggtgagtatttttagatatcctcagccttttcaggctttttcaatccattttcctcactcctttgtgaaacttgagctggcctgacaccctgagagtgcggaccataggttccttccatttggcaactccacggatggcttggacttcagtttcctccacagttcacactaattacactgactgggcagagcccctgctccttcctttcgaatgtaagatgtgtaataaataccttctccaaggacctgccttctctttatcactatgtaccaagtccttccactccttcaactgtcattccataatttacatcttaatttaataaaaatgtattgagtggctggtaacgctaggtaggtgctaaagataacagtggtaaagattgtagatgaaggaggtaaaaatatagaacatttaaacaacatgattagcaagaataatctagtggacatgtatataacactattactaataactgaaataaacttttttgtgcatacacacaatgtgcataaaatttgaacacatactggagtataaagcaagcgtcaaacaaattttaagcatttggtaccacgctggcaaatggtatgctagtaaactacctctgtgggaaagagaaataaaaaagccttgatttgcagcgattccctattcatggtattaatggtattaccattaatgtaatacttaattaccattaagtattcatggtattaatacttccaccacagctgatttcaagctaccaatggcttaacgatgggtttgcaaaattcctgaatctttaacaatcatatattgtgagtcaacatgaattggttgtagtactttctgactataaaaataaggctagccatgaatttaaaaagtttaactggccctccccctcatttgtttggatattaaaagcatacttctctagctcatatgtcaaataaactataatgggttttcaaactgaatgatagtgaacacactgtataggaaaactcatgggatgcaacaaaaatattcttcaaggaaatttttttttttttttaaggcagaatttcactctttgtcacccaggctggagtacaatagtgtaatctcggctcactgcaacctccacttcccgggttcaggcgattctcctgcctcagcctcctcagtagctgggattacaggtgtgcaccaccacgcccagctaatttttgtatttttagtagagatggggtttcactatgttggacaagctggtctcgaactcccgacctcaggtgatccacctgccttggcctcctaaagtgttaggattacaggtgttagccactgcgcctggcctacttcaagggaaatttgcatccttaaatgattacatttaaaaatagaaaaagtagaaaacaaattaactaagattcaactgaaataaaataacacaaataaataataggctaaaaaagctgaagaaaataaaacgagggacataataatggaaagggcagacttcaacgaaagataacacaatgcataatagagaccctccccatcaacagatagtagttggtttactaaagtgatataattaaacttcctataaggtcgatcaagtaaaaagaaaacccaagcaaaataattagaaaggggcattatagatgcatcagaaattaaaaaatacaagataagattagtatgaatgattttatgccaataactttaaataattcagatgaaatagatacatttttggacaagtacaagttacccaaagtgattcaagaatcagaaaatatagatggtcctatgcgttagctatctattgccgtttaactaccaacctgccagtcgatgacttaaaatgacaaatatttattattgctcagaaatccacaggtcagttggattgtttctctgtctcagtgaggctgactagcagactgcagattaggtaggtggctctgcggatcgaagttgggctcactctcaaatatgcttcaaggaaagttggctataggacagcagtaaagtgtggcctcagttgagacaaactgcttgaccactagatggtctttcatcctccaacaggctaggtagggcttgttcttgctggtggcagggttctaacataatgagcagaagcacaaaaggcctcttgtgaaacagggacagtggaagaactgcattctattggctaagaaattcacaaggctagtccagattcaaaaaaatgaggaaatagatactttctctttagtgagagggcatggatatagagaagaatggagaactgcaaccattcttgtaatctaccacatcctaaaataatcaaagatgttgattcagcagttagaaagtcttctcaccaagaaaacaccaggccagatgcttcttactggcaagttctaccaaatgttcaaggaacagacaaatccaatcatatgaaatatcttcaaaaatagaaaaaggaccatgtcataattcatttttatgaggctattaaagcccagacaccaaaactagacaagaacagtgtaaaagaagaaaataatggcccaaatgtattaaagataataaacacagaattcaaagcacaaattaaagaaactaaatctgtcaaagtataaagaaagaggatgcacaatagccaagagtttattttaggaaagcaaggttggttcaaccttggacaaatctattaattggctatattaataaaatataggaaataaactccactagattaaaaaaaggactaaataaaattcagcaaacatttatgattaaaaaatatggtaaatattaagaataggcttgaggctagtcgtctgagaccagcctgagcaacactgagactctgcctctaaaaaaaatataaacatttattttaaattaggaaaaaaagaacagaaaggaaacttcttaatacaaaccaaaacagtatctaccaaaacctataaccaaacatcagtcttcatgttgaaatgttaaaagcatttattttaaaaccagaataaaaaactgacagttattttattaaacattgttttggaggtcctagcttatgcaataaaataagaaaagtaaataaacatataaatattagaaaggaagaaaccaaactctcattatctacagatgatattatatgtctatgcagaaagcaaacttacaaaaaacccataattagatataagaatttagcaagtttgtggaatattatatctatatacagttaatttacatttctctacaatagcaataaacaaaaaatgtaagcaaagtcctgattatcatagcaaggtatcttctaactatctacatattttagcaacaaacataattaaatatatataagatctgatggagaaaattataaattgaaagcattaaaagcattgaatgaggtggtggtggtggggagttaagaaatgttgatctaagggtgcaaactttcagtcttaagatgaatgaattctgtgatctaatgtccagcaggatgactatagttaataatactgtattgcttacttgaaatttgctaagagtagatcttaagtgtctacacacacacacacacacgataactaagtgtgatgatggatatgttaattaatttgatcatcattccacaatgtatacatatatcaaatcatcacattgtatatacaccttgcacgtacaattcttatttgtcaataaagctgtcgggaaaatgcatgagacaacctaaataaatacagagttagttcctatttatgcatacactcaatattttaaagatggtaattcttcctaaattaatatgtagatacaaagtaattccaatgaaaatgtccaagcaggtttatttttatgttttatttatttttagtggaatttgacaggctgtttcagaaacttacctagaatagcaaaggccaagaattagcaagacattacttaagaaacaaattagtgaaggggacttgccacaacacatatcaagactatatgaaataaggccaggcacggtggctcacatctgtaatcccagcattttgggaggccaaggcgtttgaggccaggagtttgagaccagcctggccaccatggcaaagccctgtctctactaaaaatacaaaaattagctgggaatggtggcacacacctgtaatcccagctacttgggaggctgaggcacgagaatcacttgaacctgggaggcagaggttgcagtgagctgagactgtgccactgcactccagcctgggcaacagactaagaatctgtttcaaaaaaacaaaacaaacaaacactatgaaataagacagtgtattattgaaccagggattggccagcagaccacagaaatgtaccagacagcatccatgtggggccaatggcagagaaatgggctatttagtaattgatgttaggacatttattcatatggaaagagaaagaaattgcatgcctacctcacaacttgcatcaaagtcaattccagatgcactggggacttaaatgtgaagggcaaaactttaataattttaggaagaagtaaaaaaagtgtatctccacgacccatggaggtagggaatgatttcttaagcaagaaacaaaaagcacaaaatatacagaaaaagattgctcaatctgactcattaaaatcagaattgtgctcattttaatgagcaacaaggaggtgaaaagccaagccgaaaagctggaagaagatatttgcaatacccagaaccaagaaggggttaatatgcaaaatatagaacgcaaacccaggagaacttatgttgataagttaatcacagaagccctctttgaggagtgacatggaagcagagatcacaagaatgagatggaaaagaagggaggaagagcactccagttggagaaaaaattaaattcaaaggcttgaggtggagaccagagatcagagactagcgtgactggaagacagaaagtgagggagaggaaggacatgggcttggagaggtagacaaaggccacagccagcaggatggtacaatgagaagccaataaagggtgtaatggagcacacctggctgctatgtaaagcatggacgaggggctgaggttacaaacagggagaccgtggaacctctagaatcgagtacaggagctttcacagaatctcagagcggcagatgcagagtcttcattaagggcatgaactctggagctagattgcctggattcctatccttgctccgctttttacaagctctttgaccttgggcaaatgactttggctttctgtgcctcacagaaaggaggtaataatagtgcccactaagtgttcttaatcatttttatgcctcaaatcccttggcagtctgctgaagccttctcagaaaaaaaaaatttttaatgcataaaataaaatacataggattccaaaaaaacccaaatatatctcaatatagttatcagccaggcatggtggttgtaatcccagtgctttgggaggccaaggtgagaggagcactagaggccaagagtttgagaccaacctgggcaacatagtgagaatccatctctttctattaaaaaaaaactaccataattttgaagttgtgatgtgaaaaagatgatatttcaaggcatctacaacaactgtaatgtaataccaaaaaaaattaacttctccaggttataaagtctcaggtaccactaattcaatggtgtggtttgttgcatacattcttaacggaaggaaatgttagatttcagtgagaggttactgaaaataaagatgtgtttctacctcccattcaagttgaaggacgctctgaattctaaccaccaacccattggacatccatggatcccagggtaaaaacccctgtttctagacaaaagttcttctaataacagctggcataaagccactttagttattgttgttgccatggtcattgtcatcattttaggaggtggcacggataatcatgaagtttttctactactttagggcagatggctttgccacatactggcactgtgacctgggcaaggcaggtgcctccttgagcttggtgccctcatggtgcttctcctggagaccctgacaggagagctatggaagggaagagccaggagaaaaggaggagaccatttctggacacatcctgccagttatcattccagcctgatgcagatcattatttataaactataactactcattctctggattttattgcttgttaagagctgagtgtaacatctttaattagagtcaggagttggatgcataagagagagagacagaaaacatctgaaattctgaatctaaaataaaactctttaaatggattatttttctaagaaaaaaatctttagatactgattggggaaaaatctttgttgtcttttttttggttgaattttgagcctgtgaagtttgtcctgaatccaacggttccataattcagggtttgtctgcttccttgcaaaaagcagccttcctgagttctgcaaggtatttgtatttatactcttgacatttaaaatattttcatatctcctatctctacttctccccaaaggacttacggggttgatgtggtcaacttttgcttgagttagccagagaaggtgcattttgcttgtaatgtacatttctttgctgcaggacttctcagagcctctgtatggtaatatgaattgggaagtccagccaggggacaaagtagtcaacacttctcaaacttgtgtgacctgcttttttatctatagaatttctcatagggctagtgagaaaatgctaccttagataaacactttaaagagaaacatttttcttaggaagtgtttacagtcactgtaattatcaaacaacaaaaaaacagggaaagtagggggtatgacaggctgaatctagaatggggacagagctgccctagggggattccacggattaaaaaaaaaaatcatcttacctgccttattgaacttgggattgtttataaaggttaaataacattcccaggtggcctgctgtggtttcagagccacttgttaggccctgggtcctctggaaccactcaggactgtggccccacctctgaggttggcctctatagctatactgaatggcctatacatatcagctctctcgtcttcctcccacatttcttcaaggcccaccctgccccctcccacagaggtgctatttgctgagactgtttttctaaagcagatggtctagaaaaagccggccacttggagcacagaaggcaaggttaacgcaagtgatgtgggctgtagcatctgggctgtcccaaacccaaggctctatctccacccaacatgaaatgaagcggtggcagaacctttcccagatggggcctgggccaggaggatgacacagtggattaaaaggagtttttggtttcccttaagcatagttgtaaacttgcatcttacttgctagaagcaagaagtcagtattttgaggggcatgtattcatccatcaaaccaactttaacttaccatctagaccagcggttctcaactgaggatgatgttgccagcttcccacaggggacattgggcaatgtctgcagacattttattcatacgttgtcacaatacagggaggttctactggcatgtgacaggtagagcccagggatgctgccaaacacctgcaatgcccagcacagcctccacagcaaagcgtcatctagccccaaaagtcaggagagcctatataaagcacttaaaatgatgcaactttactattattgctccgtaaaaggtgcttgaatttgcccctgaaagacaggaagttgacagatgcacatagacctggacatgccaggcagtgcagttatgtatggccaatggttgggagagtttgtcaaagagacagagtataaagatgtggcctttcgtcttgtacggagtctagaactgtgctgtccagtaggactttctgtaaccatagagaagttccgtatctactgtccaatagggtagccccacacatggttactgagcacttgaaatgtggctagtgtgaccaaggaactgaattttaattacaaaaattgtatggggtacatgtacaattttgttatatgcaaagattgcatagtgattaagtcagggcttttagggtatccatcatctgaataatgtacactgtatccattaactaatttctcatcatccatccccctcttacctcattaccctttcaagtctccactgtccataattccactatgtccatgtgtacacattttttagcacctagttatgagtgattttctgtgcctggcttgttccacttaagataatgacctccagttctatccgtgttgctgcaaagatacaatttcattctttttatggctgaatagtattccattatgtatgtatatcaccttttcttgatccactcatagtattttaaattttatttaattttaatgaattaaaattaagatactgcacatggttagtggctacgatattggacagagcaggtttagaagaggagatggtgttgatgcagatgaaatattgacaacacatgacattggaccagcggggatggcgggggggggggtgtcccagttggggtacaggaaatgaggggaggaagacatcacttctgaccaggcacttcatggaagagacactgggaaagcttagcccaaggtgagtaggtttttgatagcagaaaatgggaccagtaagggagagcaaattccaggcaggggaagccatgtggtcaaagacataggcagggacatagggagacagcaggcctgtctgcatggatgaaggacaggtcataagacaacaataccagaccatacaacaactgtcattctgagagatgacagcgtgctggcagtccacacagccctcgctccttctcggcgcctcctctgcctgggctcccactttggcggcacttgaggagcccttcagccccccgctgcactgtgggagcccctttctgggctggccaaggccaaagccggctccctcagcttgtgggggggtgtggagggagaggcgcgggcgggaaccggggctgcccatggcgcttgcgggccagcgcgagttccgggtgggcgtgggctcggcggaccccgcactccgagcagccggctggccccaccggcccgggcagtgaggggcttagcacctgggccagcagctgctgtgctcagtttctcgccgggccttagctgccttcccgcggggcagcgctcgggacctgcagcccaccatgcctgggcctcccccaacctccatgtgctcctgtgcggcccgagccaccctgacgagcaccgccccctgctccacggcacccagtcccatccaccacccaagggctgaggagtgtgggcacagggcccgggactggcaggcagctccacctgcagccccggtgcaggatccactgggtgaaggcagctgggctgttgagtctggtggggccttggagaacctttatgtctagctcagggattgtaaatacaccaatcggcactctgcatctacctcaaggtttgtaaacacaccaatcagcaccctgtgtctagctcagggtttgtgaatgcaccaatcgacactctgtatctagctactctggtggggacttggagaacctttgtgttgacactctgtatctagctaatctggtggggaggtggagaacctttgtgtccagctcagggattgtaaacacaccaatcagcgccctgtgaaaacagaccactaggctctaccaatcagcaggatgtgggtggcgccagataagagaataacagcaggctgccccagccagcagtggcaacttgctcaggtccccttccacactgtggaaactttgttctttcgctctttgcaataaatcttgctactgctcactctttgggtccacactgcctttatgagctgtaacactcactgtgaaggtctgcagcttcactcttgaggccagcgagaccacgaacccaccgggaggaaggagcaactccagacgtgccgcctaaagagctgtaacaccgcgaaggtccgcagcttcactcctgagccagcgagaccacgaacccaccaaaaagaacaaactccgaacacatccgaacatcagaaggaacaaactccagacacgccacttttaagaactgtaacactcactgtgagggtccgcagcttcattcttgaagtcagtgagaccaagaacccaccaattccggacacaattccaactaggcaatgtcaaaactagttactcttgggagtccgaggcaggtggatcatgaggttaagagttcaagaccagcctggcaaagatggtgaaaccccgtatctactaaaaatacaaaaattagccaggtatggtggtgggcgcctgtaatcccagctactcgggaggctgaggcagagaattgcttaaagctgggaggcagaggttgcagtgagccgagatcgtgccactgcactctagcctgggcgacagaaggagactctgtctcaaaaacaaacaaacaaacaaaaaacctagttactcgacaacatacctgctgtaagccctggacactcagacatgaagtggagagaagtgacttggaaaatttaaaaagtgctattttatgggacaaattcttactgaatccaccagaaagtggtagatgtgggtcttgaactcaggtctgtgtgacttgaagcacagtgttttccactgtaccccatgaaggcaccaagtctgtgtgtgggcacagaagttgtagaatctactatgagaagttggaaaagcactaaatacaaattttgacaatttgacaatttgcctcaggctgctctggtttctggaaaccagttaatgatgggatgatgtggtagaaaatattaatgaggataactggtactacaaaactcccacagacactcagacattgcctcaaactttccctagaaatctacaaattattgtgactatacgaagcagtacttatttattagctgctgaggctggactaacggtggcaattgctttggggatttcactaccaggagacagagaatctccacataggaaacctgaggtttgcaatggggtttgctgctggagcaagaaacatttatcttctaacatgaggaacatctgcaaggtatgccaaattgcagtgttcactgaagacacgtagaggacggtcaataaggtgaaaatttctcatgacaaaaggaaatcatcttgtgcaaaccaaaagtttctcagttttggttactggctagaatccaggattcttatgtaactctgggaaacaacaatggacccccaaacaggtagatttttgaagctgtgtatcttagaatgtttagcaacattttaattgtttccattttatttatcgaagagagattccctcttcgataactaagatggaaacaaaaatttgatagtctctgggctattaatcttgaaaggaagaaaaaaatcacgagatgtctcaaagtaaatatttggatgttaaaaaagagaaagagatacaaactttgaatacatctttgaaaactgagcacactgctcctgaaagttatcccatagaagagttaaaaaaccagaaaaacaggagctttcaatggcataatcaatctgtggatagcttaattcatgattttagtcatgtgatattaatacaaaatttcataacttaaaggaaaatttcaaagttagcttgtaggtctccactcctttaggacttaaggtctgtagagttttactctaactagaacctacggcaagaacgctaggtaacaaggtggtcatttttttacctccccggtttgtaaaaccctcagtccctttcatttctcagacactttggattaaacaagatgtgttttcaaactactttgtctcttaatttttaaacccttgtttattttaacttaaatttaatccacatgtttctgattcatttacacttaactcatcaaaatgctgtttcataaaaagctctttgatgttcaagttgcctttgcagctatttttaataaggttttttttttttttaaagcttccctacttagaaacagaaagttccatttcattgctatttaataactaggggtccacagtgttgggttcagttcattatttaaataaaataatgtatgtaaaacgcttcataaattctaaagcaattgctgcctgttagtgattacagctgctattgttattgcaaccatgcagaggggcatacggaggatcgaggtttcttcttccctaagttcgctgaactagaacatcttgtagctctgtttcctttataacattttcttattctaggactttctcattcttagtaacaagtacaataaacacatcaaatgactggtaaaataataaaaaaattatgtcagcttgagagccacccacacacaaattgaaccccttttagttgaggtctcacttggacctataggctgaccctcagtggggctgcgtgtccagttgcctgtcattgacttcggggtcaggggcttctcagtgtattatttgcatgaattgatagactttgacagaaaaatgattcactcaaagggaagctttgtaagcaggcactggggcaggagttgggggtggataagcaggcaaggtggggtctgttcctcagccccatgtatgcattccaagtcttgtggagagctgcatggaaaagctgcagctgtttgcaaggggggctctgggagatgtgggcacataaggcgctgcttaggatcatcaggcagtgtgaggtagtagaacattctgctagttctgggtagaactcagccctgccctggccttacaggaatccctatacgttgatgagagtgtctggtggaatagtggggcaagggtggctgagattctgtttcctggcaggacatggcagagaagttttggcaatatcctcttttggcaataaccaattgcctgtatgattatcacccagttaaagctggtttaagtgcatatgagcctccctggggttcccagaaacactttgggatatatgtgtgtgtgtgtgtgtgtgtgcgcgtgtatgtgtatgtgtgcacacgcacgcatatgaagaggaggggttcccatgtgtctctctgaccccattcctcactggaatgtgctgaggcccgaggccattcaggttacatgtgaacatagcaaaacggccattctgttgctctgtgctcacagttgtgcggaaggcctccgttgctctcacacaagtgaacaggagtgctttgtctcctggaagccgaccctgatcctgtgtgtgaagcatagactttcagcttttgcatgctctccccatggcccggactgccacacaccaggctgccttgaggaatttggaaccaaacatgaaaagtctttctcaacaatagagggaacattgctttgccctttcacacatcagtctttcctggtgaatggcttcccggccttctgattcttgccgtatggaacaattggcctgttcagttaacttgccagcagtaatcagttattttctcctcgccatatatttcaaccattctttttggaggagaaagaaattaaagaaacaaagggaagtggctataaagaacagaactgtcagaatagcaagtgtttgagtaatttgttgggtccttggtttagggttgattgattttagcactaattttggtttggagtatttcttgggacaaagaaaccctattttaaactgcatctccattgaagattgtgattaccagaggggaaatgctgtgtaacggaggtcttgttataattccataacctaattgattattttcccttctttttttagaattcagatgtctgtttggctatctctcttttcatgaaataagccagatctttgacaacacccactgaactcagtccatgacagatattgcccaaaaaaccacctggtccagcaaaactgtaataactgctctgcggctcagtccactgggtctctttcgaaaaagggggaagaagtccccaaatgactgatgttcttaggtccagccacagtttttcattgttctcaaagcacctggtataacctgcttgctttcaattcttctgagagcctgaggatttgaaatgaaaagagaaaatagaatcccctaagtccacgggcaaggcaatatgctcttataaagaaaacacggaacatttccgaacatgtggtccgctcagctgccctcgtcagggtcagatttatgtatttgctctgcaatcaagatttttgtacaccaggcacaataccttggggtatttacagtgtaagctattttgctaaagcaaacagctgcaccgaggctcagtaaacccccctgtccccagacacaggagccagaaccttctcgggttagcaggtgtgtgtcctaactaggaggaggtgaaatttctttgggcctgactccccgaatgtctgaacattttccctttctccaggatgtgatctgatgacttccgaaagcatttgaaaaggagattctttgcttattttccccttgataagaacaaccaaaaagggtacagttattacaatctgaggggaagggctgggttgctttaagaggaagctgtagataaagtctgagctgtgacaaaggcactttatcatcatcttctttttctgttttttagttccctccctcttttctggcagagagggtggaggccatggtcacgagcaggaatttaaaagggaaacggaaggcaaaaagcaggagactgcttttaccccatggaatctcaatggtcatttttgcttgtgagagactccttgctggcttccatcagtgggaaggacaaaatcacccgcatatctacagacaggactttaaaaaacagaggtggaataagagggtggagtgatgtatctatttattcatccaacaaatatatattaagtgcccactggttttggggctgagattactgtggtaatggggttggacatcatctctgcaagagaccaaagatgtctccctcactagctaactgcaaaatttccacaatttcaaccattttttaccctggtctgtcctcctgccttattcttcaaagctagcagtgtagtatcttcaaatcattctctgcttttaaaaacttttattttttgtagagatggcgtttcactatgttgcccaggctggtctcaaactccaggcctcaagcaatcctcccacctcatcctccccaaaaagctcggattaccagcatgacctacctgcaccagcctcctacatccctctaataaggactcttgtgatgacattaggtccatccacataatctgggacaatctcctcatctcaagattcttgataatatttgcaaaatctcttttaccatttaagataacatattcacaggttctgggaatatgacatatgcatcttggaagccactcctcaggtcaccaaaattccattttgagatatttaccaagtggatccttaatatataaacaaaacaggccaggtgcagtggctcatgcctgtaatcccagcactttgggaggcccaggagggtggatagcttgaggtcaggaattcgagaccagcctgaccaacatggcaaaaccccgtctctactaataatacaaaaattagccagatgtggtgatgtgtgcctataaactcagttactcaggaggctgaggcacgagaatcgcttgaacccaggaggtgaggctgcagtgagccgagatcgcaccctacactccagcctgggtgacagagagaaactctgtttcaaaaaaaaaaaagccaacaaaacaaaacatgactattaaaatttataagagtatatattaagttgaatgcagatatatcttttttactcatttcatcaacaaatattcctaaatatctatatgcaaagctttgcccaatctttccattgtcagctcaagaagagctcttccttgatgttattttctctaccttcctcacaaggattgattcccccttctcagcatctatatagagtctggcccagagctggaactccgtaactgttgactgacattatttcaatgacatttccatgttttttctaccagcctctaagccaccattccttaaagcacgtttcacaaaacacttgtctcatgagattacatcacatacaaacagttctatggtcaaaacatttcaggaaacactacatattttactctctctattggagatttgcagtagtgtgcattagcttattaaagactctgacaagtcctgtgtgtggcatggggtaggagtggggagaggtaatttaacatggcattttccagatttacttgccagtggaattccttttcctataaaatcaattaacatcacgttttgaaaaatattgctctagggtccttggggcaagaaccaaattgtgtccttctttgtatcttttgtggctggcgtgtccctgggatactgtaggtgcttcataaacacatgttgaatgaatgcattaaacaagaggaaaaccaagttgataaggcaaggttacttctctcaagttgctaaaaatgaataagacatatgtgtaaataattatttatactactagataaattacaaagtgatctaagctaggattgttaataaggagaaaatcaaatccaaatgctgaaaaccaacctaagaattaaacagaactaggccaggttactcaagccaccctttgaactttgtggactgccctctttcagaaaggaacaaagaaaattagatctgtgtagcacagagcagaacagaaaggaatagctgtcttcagataaaaaatgaaaattgttatagaaaagattaagctaggattaaaactccaagtcaggtctctactgcaccccgagtgatggctgagaacccagtactcatgtccaattgtgtctgtgaaccgcaggcagtcagtttgagggagtgaacccatagctggctgccaaatgttgggcatgaattttccaatccaagccaccattatttatcagaaatgaaggttctcttgacacaggaagcaggaatggtcttgctttgagatggcgccaaaggccagggcaatcatggatgaaccagccattccagcagctgctccacgctttgctgggttcccctgttggttgaatctaagagctaattcatcccaggtcatgaagtggcagcaggcaatctttcctatgtgttctgccaaagtcactagttcaagcaagaagagaaaaaagctggtatagctccattgaagaggcaaaagatttggggaccaccagaaagatttggatttgaatactggctttgtcatccgtgactgtatgcaagttacttaacttctatgagcccatgccttcagttgagaaatttgaatatacctctgcatagggttgttttaagtcctagaagtaaagtttacaaagcgtatgaagtgtatgtagtagttattcaataaacaatagtaggatagcatttataattaataatgcttatcagtaatataaaatatgatattaacataaaatgttataataaaatatgagtaaaggatacatttataataaataatatttatcagtaaaaaaatggcagaataaaatttgagtaattttgttttcttatacctctttcaggatttctttttattttataattttgctcagtatttgggaagttgttcattctgggcttattgcctcagggaatagatgaagtagcaggaaagcaaagaagaaagaacctctttcggactttgagtttcaaaagtcagacaatgaaggaataaaaaggaagactcatgatatagacttggactgcccaacatggtagccaccagctagctatggccattgagtgcctgaaatatggttagtctgtgtgctgtaggtataaaacacacaccagatttcaaagacttagtgcaaaagagaatgtaaagcacttaattaccggtatagctgaatgttcgagtcccccccaaaattcacttgttgaaacctaacccccagtgtgatggtattaggaggtgggcctttgggaggtgattaggtcatcaggatggagctctcatgtatgggattagtatctttgttaaagaaattccagagagtttctgtgcccttctgccacttatgaaccaagaatctgtccctcaccagatacccctgccagtgccttgatcttagacttccagcctacggagctatcagaaataaatttttgtgattcataagccacctgcgttatgccatttagttataggagcctgaatgagttaaaataattattaatttttaaaactgattacacattgaaatgaaaatattttgagttaagtaaaatgtattattacaattaattttatctgcttgctttcttctaaatgtagctacagagaataaacatatgtagtttacgactatagccacattatatctctttggaacatcactggccaagacaatgaaggaatagaaaagacttacggtatagacaattaatctagctgaaaacatagtcagtctgagcaaggtttcttgctcctaaaattagaaaagaactcctggactgggtgaggagggtcaaaggcataacgtgagagctaagacgcaggttcattcttgtgacctgcatgacccttaactctctagccttatccctggagaggagatggcgttttccccagataaggttttgggatcagagggaaaggtacttgtgcctcctgtgccaggcagagttctgatgaggcagcaagattccagaagagaggactgtatggtcatcccagcaaaccaggccttaacagcgtcattacatttcccacgctgcaggagaagaatttctacacatccccagagtggcacagacatagcagagcaactactagatttatagaagctttggctgggcatggtggctcatgcccgtaatcccagcactttgggaggccgaggcgggcggatcacctgaggtcaggagttcaagaccagcctgaccaacatggagaaaccccgtctctactaaaaatacaaaattagctgggcatggtggcacatgcctgtaatcctagctactctggaggctgaggcaggagaatcactggaacctgggaggccgaggttgcggtgagccaagattgagccattgcactccagcctgggcaacaagagcaaaactccacctcaaaaaaaaaaaaaaaaaagaagcttcgcagataggatcaggggctgactcagcagaaatctgaacagactgacaacctaagaagataaaggatgatgggagtctctgtgcaaattgccttaggtcaaattccctagaaacagagcccaagatggggattcttgtgaaagtgactgcttgaggtagtgtacgcaggagaaacctgaaagagaggaaagcaaacagaatagggcaggggaagaaattaggcagagacatggcttcaggagtaaagcagcctctgcctgatcccatggagaaccctgcagtgtgaagttgcatcacagaatttgttccatcttgaggcacgaaggccgagctttaatgctgctccgtccatcattagttacagagggacctgaaggggcctttttcatcatcttccaggcttttctaagagaagtggctccactcagcggaggacaatactcctgagaatgatgcagaccttcagcagccaggggatgagagcaggagtctggggaaagaggactgtgctgagcacccacagcatctgccacatggagaggattcagcgggagagtacatgaacccccttccattgccttggcacaacggaagtctcatccttggcattgagcaacaactctcgggaaagagggaagatcctaagtcagtagaaattaattttttcccatctttgttgataggagacttgatatagtacttaaggcaaagaattgaaaaataaaattttatttcttacatacctgaattatagattgagattcactctttattatacagcaagctaaataaagttgggtacaagatgtatatgagaaaaaaagaatgtccaatggcaaatatatatgattttcttataaagtaaaaacacactgggcacagtggcccatgcctgtaatcccagtgccttgggaagctgagaaggaagtgtggcttgaggctaggagttcgagaccagcctgggcaacacagtgagatcctatctctaaaaaaaaaaattgtaaaaattagccagttgtggtggcatgtgcgtttagtcccagctacttgggaggctgaggcaggaggattgcttgagcccagtagttcaaggttgcagtgaactatgatcacgccactgcactctagcctgggtgacagagagagaccctgtctcgaaaaaaaaagaaaagaaaatttaaaaaaagtgaaaacaaaaagaacaagatttataaatcttttccagtatgggctattggtaattctggtgagaaatatttacacattctagtggttacatgatgcaatgtccaggtggatattaaatggactgtgacgaacctggaatgatggtactgacactgtaaatatctcattaacagattgccccaacctgtaaaaaagaaagcttttactgacttattcatgtggtcaccgtatttgctagagaattttacacacatttagatgtgtttaattcaagggaaaagcaatcatccggactagaggaagttgccaatagctcacgggactaaaatttttcatgtgtgtcgtttaacatgggtccacgtaacaggtttttcctatctgtatttgacagattaattaaatcaattccagtttacattttttatcctattctaatttagaaaccatcagctaagacttagaaagctcaaaaaaaaaatcaaaaacaataaaaggccaaactcctaagtgtatgtaaagaaaatacaaatttggcagggcgtggtggctcaagcctgtaatcccagcactttgggaggccgaggtgggcagctcacaaggtcaggagtttgagaccagcctgactaacatggtaaaacccagcctctactaaaaacatacaaaaattagccaggcatggtggcgtgcgcctgtaatcccagctactcgggaggctgaggtaggagaattgcttgaatccaggaggtggagtttgcagtgagctgagatcacgccactgcacttcagcctgggcaacagagcaagactccgtctcaaaataaacaaacaaacaaacaaatttgccaaatgtttgccagcaccaagggtactggtaagttcttctttccatttcccttccaaatgctgctgctcattatactacttttcccttaatttgatttagaactcatatgcagtctgtactatgatgttcttgactacttgctgtacaatttatcttattctatcaggtcattcgcttacttaactcaatgaatatctcttgggtatctaccacatgccaggtgctgtgctaggcagcaaggatccaatggtgtacaaaacaggtcctgctctggtcttcatgaaacttataataggtacttggtcatcaactgggctaacagaagacatcagatctatatatttaacctggtttctttctgtctgtgtgtgtgtgtgtgtgtggttttttctgagacagcatctctctctgttgtccaggctggagtgtagtggcatggccatggcccactgtagcctcaacttcctgggctcaagtgatcctcccaccttagtaccctgagtagttgcgcaccaccatgcctggtaatttaatttttttttttttttttgtagagacagggtctcactatgttgcccaggttgttctcaaactcctggtctcaagtgatgctcctgcctcagcctcccaaactgtgggcattacaagcatgagccatcatgcctggcctctggtggtttttgttcaaagtaatatttgtagctagtcacagaaacattgactaatatctactgttcatcaagggaaggtacgtagggctgtaaagatgtcctcaccatttcatcctcataataacccacttattcccagtacacagaggagggaatttgactccaagcccacacagcagaccaggccctaacttctctctctttttttttttttttttgtttttttttgcttttccccttgaaattatttagtggattgtgcgtattatcacatcagtcctattccttctggtttaaaatctcctctgtttcttggtggtaattttcaccatctgctccgacatccccttgatcttgatgtcacattggaagagaactgataaatcagtgcctgcaaggacctatgatggtaccaaacagagagagagtagagtctgtcaatgaaaatctttcagaactaaaagtctgcatctctgacaaagggctttcaggtgctgcagcaaagatggtttttcgtaagtaaatttgctccttcttccttagcaatggaacactcattctttagctgagatcatgaccctcatggatgacatctcttagtttcctttgcagctaaggtgaccatgtgattaaggtttggctaacggtatgcaagaagagcggtctgtgcaaccgccaggaactatgccctgaaagaaaggtgatgtgtctttttatagctgttccttttggctagaacacagacatgaaggctggggctcaagcggccagattggaagtagtgtgctgatgatagtggagcaggaacttggaaggagattgtatctgatgatcagggagcaccttaccggccctggactgcttacctttggactttgtgtaagagagaaatcaacttcaatctaggttttgtgactttaggttttgtattactagcagcctaatttaatcctaatgaaacaggcactataacaggaaataagaatatcagccagtgactttcctggtatacttgagtcagggaattactggttctgcctgcttatgatgcttatccatatactgtccttaagccagaatgaaacttgactaggaaactgggcttatgaatgatcagaatgtattccagcaattgtatttcaggtggcaaaacccctgcttctggaaagtcctgggagagtcacctgcccctcagtctggccttggtataactttccccttgggaagcacatgtctgtgaaagcagctattgcctctatcaccccagcctctagagtcacttacctagcccggaggagttacaaactaccgtaattgtctcatatacaaaatgactttgtaaaaagaagcccagaaaacagagaacaaagaacaggatcagagcttcagtttgaaaatattgctacagaatggatttgggctgggggtggaaaattgggagcagggagaaaaattaggaaggtaatgagataatccaggagacaaatgttgagtgctggagctaacgcattgggagtagaaatgtaaaggaagcaacagcttaattagaattgttgtgggcatgagattacatagtgattattcataaagggaaaagagggcaaaaaaatgagagccagtaaaagagatggagaaggtaaaactataggggtaggaggaaaagcaagagggtgggcatcacagaacagggtacgttttaaagaagggagtggtcaacagagtccaaagtactaaagaggtcaagaaggataaggagaaattatatcaactggcttctattggttttggcaatatggtggccattggaaactccatcctgagcagatctgctaaactaatgtgcatggaagccagattgcagttgactgagggattaagacctttctccatcctagaataaaggaaggagtgggatgaagggtcatttctttgggattacaggaactgctaacacagacatcaggtgaaagcaattcttacaagaatcttggtttgatatcttagaacactttcaattcatactgatgttgtctttggctcactggaaatggtatgaataaaaaaacttcagcattttgactgacctcaactttttggatgttttgactactacccagtcagttgggccaaaatcaactaagaaattatgcacatgggtgtgatagttaaatacaaaatgtttactgtctgtcccaagagatagtaaggaaaagttctgttaattaggtcctgtgtacatttccattatcatggctaattacctgttttattcaatgatatactttgttaattaccactagtgctcttggttctcagcctattttaaacatcttacaatgctttctttatcttctaggtgtaattaccagcctagcttttgtttgtattaagaaggcaagatacatggaacacgatgtgcaaattacagaagctaccccgtctttgcgctttaaattgagaaatgtggtcagaaactggtcacattttagagttagaggtgaagttattaaggttattttgtgcagcagttctcaccccaggagcagacaaaagatttcttggtggaacatgggaattttattctataagacagaatcagatgttactatcaaatacatttctatactactactacagttttgatcctcaaaacttttcatgtgtggccactatgacaacaaaatgtctataacattgtgtttctcagaaaaaagtagacttttgatttctatcacaagttccaggttgttgaaagagtgattgatggtttatgagatatttgaggcattatctgcattttacaaggggaaaaactaaagtccatctggaggacaaaggaccttcacagaactgccagttgtggaaacagcaaagttagaactgaaattcctcccttttctttccactaacctgaaccccacacagtccatgctgaaaagggaggataggtgaggttctggggtcacacagaccttgctttgaagcctgggtccctcccctctaaatctcacttgcctcatctggagaatgggaaggacagtagttgccacagtactgggattgttttgatgattaaatgaaaaaacgtatgggcagttctcaccttgtgcttggcacatggtgatttcccaacaaacatcagctggctttaacaacacagacccagagctggctgtggctttgctgggtgccccaactccagaaaaaagtctagcatccctgtaaatggaaatgtgatcagtcttcaccagattggcatctatttgctctttagacacttgctgatggtcagtttcaatttagacccagcaatggcaatattcaaacatcaaaagcatgtgggtaaaaacatactccttttttgttgttttccacatatgtgtatctaaataaattaattggttggccaccaccatatagggtcctatgactatctgaggccaaatctattgaggccagagggtagagcaataaggagtattgaacttccatcatatttcctgaatactctgtgatctactagaactttgggaaaattacttgacttctctgtgcctttgcttcctcatctatacagtggaggtaaaagagtacctacctcttgggttattgtgagaataaaataagatgctgcacataaagtgcatagccaaagacagcacatcgtatgtcctcaattactgagccattagcattgtttctgtctcctctgcaaccacgaccatctcattgtagagcttggttctaatcaggatcaggatatacaaatgtcatatgcaatttgtagaatgctgcgggtttgatatttgcattgttagttgtgtgtttgaattctgtcctccagatatggtcttacaaattttatttatccaaaaaatatgcagtgatgatctttattgagcctttgaaatctactttaaatgctgctgtatactatatacagcagtcctaaacttccaaaagtaaaatacatcttcttgacaatgggcaatgccttatgattagtatcaaaaccacaaacatgtaagatttatttattatgtgtcacatgactttgatagacattatctcagaaggcctcaggccttatgagagagtgtcatagtcattagggctgttcacacaatttcctgcctctttcaagtgtggtaatgaggtaggaggtgggacttgactttagaggcggagcttagacactggaccaaactgaggactagctaaaacagggacagagcagaagcagctttccataatacatgcccaccagtgtgccatgtgagttaccacggccatggcaacaccaaaacttaccacctctttccatgaaatttctgcataacctgtcccttaatttgcaggtaattaaaagtgtgtataaatatgacttcagaactgtctttgagctgctactctggacacactgcctatagggtagccctgctctgcatggagcagtacctttgctgctgctgtacactgctgcttcaataaaagttgccgtctaacaccactggctcacccttgaattctttcctgggaaaagccaagaaccctcccaggctaagtcctaattttggggctcgactgccctgcatcagtaggactgcactttttggtttctttgaagttaggtggggacatgtgacttatttggccaatgagataagagtgttagtaatgtgggtcacttccaggggaagcagtgaattgccagtgtgagacaacacagtgctctctggtcctcttctacagcgactatggaagcacagagattgaacttctgttgggcaggggccgtgagtgatgataacaaggaatacagcctattactgatgtgtgaggggcatgaagtgtgggtgagaaataaacttttttgtgtgctaagtcactgattttgtgaggttattatggaaataacatagcctatcttgacaagtataaggagagactattattattcccatgttacagaagaggaatgggaggcacagagcagttaagaaatttatccaaggtcacacaggcaggaaggtggaatcaacattcaaacctagatgtttctcactattaaatgatgcctttaacaactacgctgttcttcacttccttccagttagttgtgggaatttatagtttcaacggaaaatgtttgtacttgtcatttttatttttatttttattttttttgagatggagtcttgctctgtggtccaggctggagtgcagtgaagcgatcttggctcaccacaacctctgcctcccgggttcaagcaattctcctgcctcagcctcccgagtagctgggattacaggcatgcaccaccatgcctagctaatttttgtatttttagtagagacagggtttcactatcttgaacccctgacttcatgatccgcccacctcagcctcccaaactgctgggattacaggcgtgagccaccgtgcccggcctgtacttgtcatttttaaagctatcttcttgaaaaattcttaccttctctatgaaggaatcattgcgcaaagtgatttgataggtttccaaaacacgaatgacttttttggggcaggggtccccacaagccagtgcctatggttctgcaggcctcttttcagtaagagaccagccttcccagtttcccagcttcttctgtctctctttaactgataagatccagtgtctggtgttgggacccaggtctgaaacctgcgcctacaccttctcagattcccatgtccttagctcaaggacttaccactctgcctttaaatattctcttcatttctgactttatcaagccccaaatgaaagacctttttgttaagtgtagttgattcctagatactacacatgctacaggaaatagaaatactgtgtaaaatgtaacaaaaatagcaaaggacatgaccgttcataaaataaataggatttaaatggtttaagatatcaaaaactatagtgaaaataggaaattatgaaaaaagaaactgcaggcttaaaaaacatggaaataagtcttttatcaatgaaaattatcattacattaaaaatacaatgaatagattaaatagcaggtgggatataattgaggaaaaaatgagtaaactgtaaagtagatttaagaacattaactagaaaaggacttaagagatatacaggaaaaagtgataagttctcattttaggttgttagaaggatagattagaaagaatgatgggaatggccgggtgtggtggctcacacctgtaatcccagcactttgggaggctgaggtgggcagatcacttgaggtcaggagttcgagacctccctgcctatatggtgaaacctcatttctactaaaaatacaaaaaattagctggatatggtagcacacgactgtagtcccagctacttgggggactgaggcaggagaatagcttgaacctgggagggaggcggaggttgtagtgagcagacatcgtgccactgcactccagcctgggtgacagagtgagactctatctcaaaaaaaaaaaaaagaaagaaagaaagaatggaagggagtgggaaagttgaagagattatatctgagaatgtatcgaaaattatagaagtattttttattttatttttattttaaagaggattccttggccagatttatgattgaaaataagccactggtacccaaagagtaaaacaaataagctgctcatttgcaaattctgccttgatgaggattatttttataattatgagtctactttattgaagtccagtagtattatttatgaaacagaataaaatagctgtactcaggcataaagattatgagaacgaggaagtcatatatgtaaagctattgttccaacctatattatgcacagagatcacaagatgaactactaaaaatgcagatggctatctcttattccaaaatcactatattcagtcagtctgccccagcaatttgcgccttttctaagcaccagcccagtttatttgatgcaggatcatccttgaacttcactgtaagaaacatggttctagcccatgcttgcattcaatgttgtattgctttgaatctggttgcttaggtatgaaaatattggctctgttgcacagggactgcccatcctctcaaagccaagtcatttcctgagataggctttaatataaaaaaacctttgaagtccattgtttgataactttacctttttaaccaaaagaggaaataaaaataaaccccacagcatttggaaaaaagaaggtaggtttagtaaaacagtaaaaagaaatcttgatgacaaacttactgatttgttcacttgacaaaaacaaaggttttcataatccactggccaatttatagtggggttttagaattgatttagaattaaatttaaacttgacttctaccatgtagacaaaactcctgaaggatggaggtagcctggtataacagaatgaacacagatattcccgtcagaagacctgggtttgaatcttggttctgtcaatccagccatgtgacattaacccctagtaataatgtacattatcctatcttggagatatttctttttgtcagccaggacataattcaacctatcttgcatgaaataattaacttccatcagtactaatatgccaaccaatgcgggatttccacccagccgtcattgacactccctaaatagccccttaggaaaggactgtcaccattataatggtgataatatatcactgctagcgataatgtacctaacttgcttagcccagttattagcattatttataatcattactattgttattcatcttctcttccccttaatcaatacgatggagaacatgatgttgttctcccttaaatttgttgtgaggatttttaaattagataattaataggctacacatttggtgcttatgatgtgctaggcatagtctaagtatcttacatgcattaacttatttgatcttcacaacaccctgtgaggttctccccatttgacagatgaggaagctgaggctcagagatgaaaagcacattacccaaggtcacacagctattaaggggtgaaactggactattgtaggtgaagagctcagtctggtacctggcagacagtagatcttaatcatggacagcattcatggtgttttgtgtagagagaacctttcctaaggggctgtcttgggagtgtcaatgatggctgggtggaaacccacattggtaggcacatttgtactgatggaagttaattctttcatggaaggtgggttgagtgatgtcctggctgacaaaaaataaaaaaaatctccaagctatcagctgcaaatgagggtggacatatatttaaataggcgttggacccaattcatcccatgtggtccccaaattaataagatctatacataattgtcatacttagaaatgtttccttttagtcctgagagaatgattatgctgcaaagatgcagttcttgagactgggtggaaaaaaaaacccttctcttatatatagttatattctgatgggccagcagtagatgcaataaaggcagtgatatttaagttgatcagggacagatgtttaacatattttatgtaagaattgtagacaaagttaactgccaaaacagactgttttcttgaaacattggacagatggaaccaacaagatatactcctgaggagtctgaactcttcaaagtgaccctaatttaaaaataataataattagtcttgatcaaagcacttcagtgatgttcaattcttttgtctctgtactttgttcactttgtcatcgctacaaaggtatttgggatgtaaaatctctttctctctctctgtatgtgtatgtgtcacacatgtgtgagtattcctggtttcaaaaacatactttgttttattttctgtcattcactgtgggaaatagtgtgctgtgcacattgtcggctctcgcccccgcgtctgcgtctgctcccctcccctctttccaacagccgttcatttctatttggggatctgtggtcgagggaggctgattccacgcccagctccatatcttgtcactactgtgatacaaggcctcctcttgttccctttcctattaagagtgaaacggcaaagtttccactgggctgtgaggcccaacaccatctggtcctatactgccctgaccttgtctcctacagctttccctactctctcactctgctcctttaaactgatgacccccttgctgtttctcaaatatgccaggcaggctcccatctcttcccttctctagatcttttagggtaggggtccccaaaccccagagccactgaccaatataggtctggcacatgcgagggatctaggttgcacactccttatgagaatctaatacctgatgatctgtcactgtctcccataacagccagatgcacccctctagttgcaggaaaactagctcagggttctcactgattctacattacggtgagttgtatgtataaatatacaattatttcattatatattacaatgtaataataatagaaataaagtgcacaataaatgcaatgcgcttgaatcatccggaaacgatccctcaccccggtctgtggaaaaattgtcttccatgaaactagtccctaatgccaataagggtggggacggcagagttagggaacatttcactgaatcgtacaagtgaagaccttgattgaattgaacagttttgcccaaatccctcactttcacatcacaaacattccagtaaaaccagattaattttaagcattcatcatttagtgtttcaagaggagtttgcaccaacattctgccctgacaagaattttagaagatgtgtatgaagtctttcttcttgtgttcatatagaacaatgtgcaattcagtcgtggggtgaacgctttgttgaaaggaactgagagagttattgactgggagggatttcaatcttgttgctattctgctgataatcacttaatgaaaacttaaaaataaaaacatctggaaagtatgccaaccaatgcctgctttaccagttttactttctggcttgcctcaagtaattttaataaagtatgttaactcaactagggtcttgaaagaattcacgttctataatctgtccctgtccactgctacaagagttttgggaataggcccatgaatttaataaaatacttaaaataatactacaggagacttaaatcttgataattatgcaaagagttgtacttcggatatattatatgcttctaaaaggatgcattttgcctagaattctgatggttgtactttaaaagagccgtggttaacgggatcaaatttaaatagtttcgattcacagatgacccaaaatgaaattcatgcaactaacagttgggagggatggtgctaccactctcttgagtttgccttataatgactctgtttaatttcctgttttaaagaaagaacttgaatggaatttcttcttaagggattgtttggtttaaacctgatcctctcgaatcctttcctaaatccctcctttgaggatttggactctggactcacctgaaggtatcatttcagttcttggatgagagacacactcttcatcattccaaagcaatccgagaaagttcttctcagccacaaatggcaccagcaagtgtacaaagcacactttgttctgtggaaaatgaaaattgttttcttaacagtgcatccttgggctgaaataggaagaccttccacctggacattaatgcaagtcagaatcattaacgttcataacagtccacattgctgtttatgcatttgatgttcaatgtatctgggtctcatttcattcaataacttaatacctgctttcattagcaactccagtttggacttcttgctattcaattcggctaggaaaatgtgtattcaaaccagagtgtctaaactcaaggccttcatacttcttttgccatggcagtttgtggagcaaaagacctcccagcctatccacccaagctctctccactttccagtggaaaaatatttcagagataacaataaagattcagtgtctgagcaaattcttttgggattatgtgtacatctgttttagcaatacaggtaaggatgacccatttagagtcacaacacgtgagatatgtgcaagtttagttattggaaagttataggctagacatactgctcatatgaataggaatttcttaactgtaaagttaagcaaacaatcccaacaaacttaataattgtgaagctaaaccaagattaatttcaggtaaaaacaaaacagaacaaaagaaaccacactaggagacaatgaaaattgcaatccagtaagatagcaaagtacgatgtataccacccccagaagtgattccaatgatcagttgagcctacatacacagtaagagcttcacagctctgtggaaatctgcctggcagacagccttcttagtagaattcagaattaagagccaaagtaatcttttagtttcaattaatgaatagcaagttttaggaattctaaataactcacttaagaggttactattacgtagcccttaatcatatataaaagttcatggaattacaagtcacaggttactattatgtagcccttaatcatatataaaagttcatggaattacaagtcattcgtgcagaagacataaaaggaataaaatgcattttaagaaatttaatgatttatttttaaataattgtagattcacatgcagctataagaagtagtacagagaggttcagtgtaccctgtacccaatttccttcaatggtactctcttgcaaaattttactattatatcacaactatgatactgacattggtacagtcaaggtacagaacatttccaccaactcaagaattccttatgctgtctttttacagccatattcacttctctcttgtccctatcctctccttatctacgggcaactagaaatctgattttcatttttataatattctcatctcaagaatattaaataagtggaatgatacactttcggaaaagtgccagattgttttccagagtgacagtaccattttacattcccaccagtaatgtatacatctttttctgtcttttgcccattttctaattggcttgtttgctttttctatttgggttttgataattcttttatagtctagatactagacctttgttagataggtgctttgcaaatattttccctcagtctattgcttatcttttacaggtattttgcggagtaaaagtttttaattttggtgaagtccaatttatctttatttaaaaaattcatggatcataattttggtgtcaagtctaagaattctttttctagccctagatcccaaagattttctcctctttttgaagtattactttatagctcaacatttaagtctgtgatccatttcaagttagtttttgtagaaggtacagagtttaggttgaaggtcagttttttgcctatggatgtccacctcctccagcaccacttgttgaaaagttcatcttttttttttttttttttttttttgagacaggatctcactctgtagcctaggctgaagcgcagtggtgtgaacacgactcagtgtagccttcacctactgggctcaagtgatcctttcacctcagcctcccaagtagctggagtcacaggtgtgtgccatcatgcccagctaatttatttttatttttgttttttgtagagacaaagtctccttgtgttgaccaggctggtctccaactcctgggctcaagtgatcctcccaccttagcctccaaagtgctgggattataggagtgagccactgtgcctggctccatcttttctccacggaattgtttttatgcctttgtcaaaatcagtttggtgtatctgtgtggatttatttctgggttcagtattctgtcccattgatttatatgtttattccttagccagtactgctcagtattgattactgtagctatttaatacgttttgaaattgggcagattgattattcttacctattctctttcaaaattagtttagctattctagtttctttgtttccacatacaaattttagaataatcttgtctatatctacaaaacctacgctgaggtttttatttttttgagacaggatcttgctctgttgcccaggctggagttcagtggtgcaatcattggtcatggcttactgcagctttagctccccaggctgaaacgatcctcctaactcaaacttctgagtagctaggactacaggcaagtgccattacacctggcttattaaaaagtttttttccttttagagacacggtcttaccatgttgcccaggctggccttgaactcttgggctcaagcaaccccctagctttggcctctcaatgtgttgggattacaggcatgagccactgtgcctggcctgggctgggattttgataggaattgcattaaacctgtataatatttgggaagaactggcatatttactatgttgagtctttcatccatgaatatagtatgtctcttcatttatttagatctttggtttatttcatcagcatttgtactgtcagcatataagtcctatacatattttatacactctttttattttttgtcattataagtgttattatatttttaatttcagtattcatgtgttcactgctagtatacagaaatgcaatttttttgtatgtttatcttctcttctgtgaccttgctaaactcacttcttagtgatagaagtgttttggtagattccttgagattttctgtttctttgtttttgtttttgtttttgtttgagatggagtcttgctctattgcccaggctggagtgcagttgtgtggtctcaattcactgcaacttctgcctcctgggttcaagtgattctcctgcatcagtctcccaagtagctgggactacaggcatgtgccaccatgcccagctagtttttgtatttttggtagagacagggttttgccttgttggccaggctggtcttgaactcctgaccttaggtgatctgcctgccttggcctcccaaagggctaggattataggcatgagccattgtgcctggcctccttgagattttctatgtagacaatcatgtcatcagcatatagagacagctgtatttcttcctttctaatctttattcctttcctcccattattgtactggctagaagttaacagtaccatgttgaataagggtgatgagaataagcatccttgtcttgttctcaatcttagggagaaaatattcagtctttctccattaagtataatgacggctgtaggtttttttgtggatgctctttatcaaattaagaaggttccttctattcctatttttctgagaatttttctcatgatacatgtcgaaatttgtcaaatcaaagtatgttcttcagtttccaagttttggagatttccccatgacctttcctttattgatttctagtttcatttcattgtggtcatagacttcaattcttttaattgctggtgtttgttttatagcccagggtatactacatcttggtatatgttctgtgggcacttttgtcagattccttttctgcatcaattgatatgatcatgtaatttttcttctttagcctattaatatttcagattacaatgactgatttttgaatattgaaccagccttgtatcttgggaataaaccccaacttggtagtcacatatgttttctgaaacttttccattacaaattcaattcctttaaattttggggctattcaactgatctatttcatattgagtgagttgtgatagtttgtgtttcttgaggaatgggtccattttatctaagttgtcaaattcgtgtgtgtagagttgtttgtagtatttacttattattttgatgtctgcaaaatctgtagtgatatcccctttcattcctggtattggtaatttgtatcttctcaagtcttgctcaaggtttgtcagttttattaatcttaaaaaaagctctttttttgttgatttttctcacataattgtttttctgttttcgattttattgactcctgctgttatctttattattttcttccttctgcttgctttgggtttatttcgctctttttctaggttctttaggtaggaacttagattgtttatttgagaagtttcttctttatatacatgtagtgctctaaattctcttagtattgctttagctgtatctaacaaattttgatatgttatatttttcattttcattccattgtctgcattttaaaatttctcgagactcccactttgacattagattatttaaaagtatgttccttagtttccaagttttggagatttccctattacctttcttttactgatttctagtttgatttcattgtggtcaaagaacatactttgtattattttaattattttaattgttggtgtttgttttatggcccaagtatactacatcttggtatatgttctgtaggcacttgacaaaatgtttactctgctggtaatgggtgcattgttctgtaaaagtcagtaacatcatactgattgatggcgttgttgagtttcttttgtatctttgctgactttctgtccatttgtcctatttgttattcagggaggaatgttgaaatctcacaatacgattttagatttattggtttctccttcagttctgtaagtttttgctcctgcattttgcagttctgttgtttggtgcatacacacttaggattgctgtgtctttttggtggatttaccattttattactatataacatttttctgtgtctctgtaattttctttcacctgaagtctcttctttcttttgattaatgttttcatatctttatccatccttgtactttaaacttgccttagatcattgtatagatagcatatagttggaccattttaaatgaaaatccttgctgtaaatctttttattgtatatagaccatttacatttaatgtgattatttatatcttagagcttaagtcttattttatgttttgttctgtttgttcccgctgtttttcacatcttttcccctgccatttatgggttactctaacttttttttagaatttcatgttgatttgatagctattttagctgtttctctaggtattaaattatatatacataacttctcagtctactggtatcattatccagttctagtgaagtgttgcaaacttatctgtcttcatgtttgattagactttctcacttataatatagttgtctttaaatagttcctctttacacatttagaattacagaagacaatgttataacttttttttgcttccatcaagtataatttagaaaactcaaaaaagagtgaaagtctgttttatttttgccatatttttgcctatagttttctaccttcctcccttctatatatttctgtttagaaaacattagccattcttttagtgacaaattttctttgttttcctaagagaattgtcttgatgatccgtttatcgctgaatagatattgggattctcagttgacagttcttttctttcagtgcttcaaaaatattgttccacttccttcttgcctccctggtttctgatgagagatacactgtcatttgaattgttttccttttataggtagggtgccacttctctcttgctggcttcttgattttttttttttatgtttagttttcagaagtttgatcataatgtgccttatggatttttttaggtttatgctgtttgcaattttcccaggttctcaattccagaaatttatgtgttttgtcaatttgggaaattttcagtcattaattcttcagagacttttcagccctgtcttttttctcctcactttctaggactttgatgacatgaatgttgtagtcccatagattcctgaggctctgtttatattttttcagtctattttttttctgatgtattctatttgctaatattttgttgaaattttttgcactcatgttcttgaccttggtctgtagttttctggttttttgtttatttatttattttttagaattgcctgtttgatgttggtatcaggctaatgctagtctaattaaatgaatgaggaagtgttctctcctcttccatgtcctgaaagaaattgtgtagaattggtggcatctttttcaaatttttggtcaaactgggcctggagatttcgtttgtggaagatttttaaaaaacacagattcaatttcttcaatagttttagcactattcatattatgtatttcatcttgggtgagttttattagtttccagttttcaaggaactggtctatttcttctaagctgttgaatgtatatgtatgtgtggaattgtgtgtgtgtgtttgtgtgtgtttttcttttgtagcattccttgttatcctttaaatatttgtggaatctgtaatgatattcccccctctcattcctgatattgctaatttgttctatttttttcctttgtcagtcttgctagagaattattaagtttatcacttttttgaaagaaccaacttttggttttactgattttctctactgcttttctgttttcaatttcattgatttctgctacttatttctttcctttgctgtaaatgtgttttgcctttttttggtttattaaggtagaaactgagttaactgatttgagaccttttttctttcctaatgtaagtattttatgctacaaactgctacaaattttcctctaaggactactttaactgcatcccataaattttctatgttttaccttccttttctttcatttcaaaatattttctgacttctcttgagacttccttttttacctatggattgcgtagaagtgggttgtttaatttctgaatgtttgaagactttttgttatcatttattgatttctagtttaatttgatcattgttcaagaacaaactttatatttcagttccttttattaaagttgttcagctttggcttatgagtcagagtacagcttatcttggtgaaggttcactgtgttgttgaaaataatgtgtatcttgatgtggctgggtggaatgttctacaaaattcaattcgaagtagttggttgaaggtgttgttgagttctgctgtatccttaggaatttttttgtttcctagatctacctattactgaaagaagtttgttgaagacttcaactataattgtgcatatgcctatacctatttctcctttcagttctgtcagtgtcggtttcaagaattttgaaactatgttacaaggtgcataaacatttaagattattacgtcttcttgatgatttgaatattttattaatattcaatatccctctttacctctgattgtatattcttttagagcaggcctgctggcagtagattctttcagttttccttcactgagaatatctttatttcaccttcatttctgtggagtttttcactggatatagaattatgcattaacagttctttaatttcagcactgaaagcatgttgtgctacttcctctggctgccatggtattctgatgagaaatctacagttacttaaatcattattttcctctaaaaatacatcgtgtttctcttgctgttttcaagaagttttttatagcttttagttcagtaattttgttatgtttgatgatgtgactcttttggtttatccagcttgagtttgccaagcttcttgaatctgtagataagtgtcttttgccaaatttgagaagtttacagccattgtttcttcaactatttattcagcattatactccttcttctctttttctggaactctgatgacatgaatgttaggccttttcttagtgttctgtatgcccctgaggctttgttcattaaaaacatatatatttttctctttactaggcatattaatttctattgatctatttttaagttatctaactctttcttctgtcatctccaatctgctattgatcccatacaatgagttattaactttggttattgtatttttcagttctaaaattactatttggttctgtttcatactttctatttaattaccaagatattctattttttcatttattccaaatgtgtttgtgatgcttactggagcatttgtatatagctactgtaaagcctttgtcagataacttcagtatctatgtcattgtagtgttgatgtcagttgactgcttttcgaggcaatttgagatttttctcattctttgtgtgcccagtaatttggattatgttctgagcattttgagtgttataaaactctgcgtcttttttaaatttgatgaaagttgttaaaatttttgctggagcaggcaatcaaactgttaggttaagaccacaaattccaacctctacctgtgggaactgttgcaaatgtagtttccatttcttttcttttcctcctcctccccctccttcttcctcctcctccctcctcctcctcctttttctttcttcttcctcttccctcacctcttctttttcttcttctccttctttctcccttcctcctcctcttttcttcttcttcttcttcttcttcctcttcttctccttcccccctcctctttttcttcttctctttctttctcccttcctcctcctcctcttcttcttcctcttcttctccttctttccctcctcctccctctcctcctcttccccctccttctccttcttctacttcttttcctccttaacatttatcagtttattataaggaatattgcaaaggatagataaagatgaagagatacatagggcaagatatgggaggaggggcgcagagcttccatccaccctgtgggaaccttcacatgttcagctatctggaagctcctcatttccatttttaaagcctttgcagtgcaattctgatgtgtcccatatgtgtccctcagtggttagttagagaccttgcccacggtctatgtgttcattcaattctcaaagtctttggtttgctgattaggatcagactcatgcatgcggagcttgcagtgagcccaagtgttcataaatagctatggggttgctttcctgagatccccctctgaactcttcctggtactttcagtttcctagtgtttctcttgttggccttctggcctgatagctggggctttagttacttttgccatgcatatctgtaactgcacaaatgtccaggcccacgtggcaggaggacagaaaaagaataagatgcagtggacgggttgtcccactctcttgggatcaccaccctattgattggagaggaagatgtccttcccttagagttttggctcctgctagctccagctgcagcctctgtcactgcttaccttggattgctcaggggacaggatgagagaaaacagagagaaggaaataaaaaaaaaaaagaaagtgggatttccatactgtgttctgagtgtcagaggctccctttcctctcttcccaagccagtagtacgaggcttcttctggagtactgtttataccccagtgctcctgtttgagtttcagggtgtgttgtattcaggccaggggatacaggaagggaaaaagtgataaactcactaccattttggtggcacttcaaagtctagtcttcctcaatccatctgctactatttatttttcagggtcctcaaacaactgctctatgcatcctatgtagattttatagtgtgttcaatgggcgatccagagtagagtgtgcctcctccatcttacctggatggggacctcaaaacatgcatttaaaattcactaacacctatcacccatcataaaaaggcttagaccatactctgagaattactggtcaaaagcagtgtgtctcaatctcccatttttttctaatacaggaacaattatatgtttatcagccttttagtcataacacagtgccattaattaaatattgtgacttaaggtcttagattctctcagcatccttaaaaagttatatagctggatattactttagctcttggttaaaatgtaatcaagacagtgattaaagacagactctggtttttatccaaagttgagaaaagaaaaagtactgctttggaagacattgtccattttgttcagcattgtttaaataaaacattcccctttgaatttcatgtaaagaaaaggttcatcacttcctatggactctcatgtttcttacatgacttaggttctcttttctggcttccagaaatctcagatcctcatatattcttggttcaattacactggatctccttagctaggtctcctgaaataactgtttttcttctactatgttacatggatttttctattttatacttattatattgatagacaccaagtcataaatgaatttgatgcaatggtgggattattagtttcctgtctttgattctttgccatttttggtatttccaaaaatcatgctgatttttaaaaatatgaaacttaaatgaaataattacgttgaacctgagtgatgagcacttgtgattttagaatgactattgattttgtatatacttgaaattctccataatagaaagttaaaagtttttggttttttttgtttgtttttgtttttgtttttttttttagaaatgattacacagtgcagctctggtataataataaaagggcaataattgaaatagaatgactagtcctgtaatattaatagaatagctagtcctgaaatagaatagctagtcctgaagctagaactagcacattaaattctgatgtatatgttgaagatgcaataataaattagcaggaaaaggaaagattttcaatagatatcttgtaatgggttaactatttgtgcagaaaaaaagttcactttcactgaatacaaaatctcaaaattaattctagttatgtctaaaaattaagtggaaaaaaattgaagaaaaaatataaaaactaagtgattttttattgacctctctatttgaggaagaacttcttaaggtaaaaacaaaagataacaatcacaaaaggtcaaagattttatcacacaaatatttcacactttgtattttgaaaataaaaaaagccacaataatccaaaaacaaactaggaatattatttgcaacaaatatccctggtaaagagtaagcagtctacatctgtgctaaacttatgtaaatgaataaaatgaacagtaagactcaagcggataaacagtcaaatgtcttgataatttacaaaataagaaatggctaacaaacatgcaaaagaagtatgttcttcattaataacctattaagggaaattagacctattagatattacttatctgccaaatgtgacagttttatgaaaagtgcagtaaaatagttttttaaaataatgataaagatttaatcaagctattttgtcaagagctttaaagctttaaaataccaagcatttgatccaataattctcctcagggagtttatcttaaggataaactttatatccttaagttaatgacatatatccttaattctaaacatactcatatataaaatatataattatatattatatgtgtatgtatatatacacacatatacatatatatgtgtctgtatatacatacacataaggtcaaagattttacctttgccatttttggtatttccaaaaatcatgctgttttttaaaaatataaaacttaaatgaaataattacgttgaacctgagtgatgagtacatgtgattttagaatggctagtgatcatgtatgtatgtatacagacacatatatatacatagatacatgtatatatatacatataatacataattatatattttatatgaatgtttagaattctgtaataaaaactttactgcaactactatatgaatgatccaacaaacaattgcacatacatttgaaacaaatgaaaaaaggagatttcagcataaaaatagaagatataaagaagaaccaaatagaaacacacagacacacacacacagacaaacacacactcacagatgtttgctgtagccttaggaaaaaaaaaatctaagacaacttaattgtccaaagttataatgacagttcagtaaataattgtatatttgtataaggaatattttgcaggcaatttgaaatgatattatttttctccaggggcttgggatatgggaaaaacatggtgtcattgttgaatggacacagagtttctgtttgaaatgatgaaaaagttctagaaatagtggtgacagttacacaacatttttgaacattcttaatgcctctaagctgtatgcttaaaagggttaaaacggtaaatttttatgttatgtgtattttaccacaatataaaaataattattttgttgtaggaaaacacataataaaaaagatcctatgttaaaaatgaaaatgtttatatatatgttaaagggaatccactgctatttttttccattagaatatactaattcatggccaggtgcagtggttcacgcctgtaatcccagcactttgggagaccaaggcgggtggatcaccagatgaagagatcgagaccatcctggctaacatggtgaaaccctgtctctaccaaaaatacaaaaaattagccgggcatggtggcgggtgcctgtagccccaactacttgggaggctgaggcaggagaatggcgtgaatctgggaggcagagcttgcagtgagcctagatagtgccactgcactccagcctgggcgacagagcgagactgtctcaaaaaaaaaaaaaaaaaagagaatatactgattcacaactgaggatgcatattaaaatcatgagaagagctttaaaatatctaaaaattctcaagatccacctcgtatttattgaactatcatttccaggggaaggcttgttctattttagttttaagttattttaaaaaataaaatctataattgattataatatatgtcccatattaagaactattcttctagattattagaggctgagaggaagcagaacaattatagtacaacaccaaatgtatcaagattaaaggaaaatagtcatacataccaaacatacacagagatttactaaaaagttatcagcagatatatttgtcagaataaaagatacctgatatttcattgtttatagtgtgtgtgtgtgtgtgtgtgtgtgtgtgtgtatgtgatttcaaattttccacaaagggcattagatatataatcagcaaaaatttttaagagagaagcagtaagtaaatcagtgaacatgttccttttgaagagaggtttcccattttaaaactagagattaccaaaaatctcaacttctactaaactgaatgttcttgacattacagccaagcatgttgtttgtattcagtcaattgaaatatgtgaaaaaaaagaacttattctgttagggttacaatatggcaaaggaccaagtcctccccatcttttccttttctaaccttgctcattaaaagcactgaatctatgggctgttttggtttctcagggtcttatcatgcttacaaacaaagatgcagctgtataggtccttagtgctgcttctgttggggctgcttctttattcatatttaacaccttccttaccttaaggacttgcaataatcaggcagagcttcaaaaaatcagatcctgggagtaagacattttgaccaacacttcagtttctgtgaaatacatttttcctcttgttcaccttaaaataccatgcccacctccatcagactttggaaaggaagaggactttgtgggttagtgagcacattagcttttaggagggcagaacttgaagggcaacaggttgattatgctcccttccaaaacaccacccaagattaggagctggatcgtcagttactgaggaaaggctctgagacccaaaccaaatggtgttttagtgttggatattttccttttgcccctccagatccactctccataattccttaccagctctgggcatagactccatcagcgggctccctcgccctctgactttccattaaatgcagtcaattagaggcattgtcaagaaatgtgagagcgacgcccgcagtgctcatttcccttgctccttcctctgcagtttggtggtgtctttctcctgaaggccacaactcctgtgaggcagccctcaagtacagctagagctatcctctccagttccaggaacttcctggtttcgtcccctttccccttcgagcttggggtgatacagcccttctgtagctaagcacaacgttccgacccacctattgctggtttcccttaacccaacccacatttttataaacaactctacacttttgtgaaattctcctcaactgtaccatggaaaggagccatgtgtaccctgccaagactttaggccacacttctcttgatgttcagtaatttttttctcgttatgccttccctaaagagctaagtataacgtctgctagccgaatggcagtgatggcttcaagatgaggcctctttacgtgatcttgtgggatgaggaaagcttcatggcaaaagaaacacatgtgaggccagatgtgctcattgaaatcaatcaacattcatcaaaggcatgatgccaggattcaccctcaaccttcagagattttctgatctaagtaagtgcagccttaaaacactggccattgacagtctctatctaaagctcacaccaacaatccaatcaactcaacaaatgccttaagagtacagtgaggagtgttggtttaggtaaccaacatatagtagatgttcactatttgtgacacaccctgctactcgctctgcaaacctaccacatttcactttagtcttcccaactccccacacagcacatattattaccaccttactgatgaggaaagcaaggcacagaaaggtcaggtaactcgcctgggacgcacaatgagcagaatacccagcattctgatgtaggtctgcgggactccagccaggcaggctctgaaggtttagagaacgttctcagagaaacagcattgcagatgatagccttgtatataagtccaggctctcctggcctgggtgaattactttgaacaccttacctaacttttcttttctttttttttttttttgaggcagagtctcactctgtcacccaggctggagtgcagtggtgcagtctcagctcactgcaacctccgcctcccaggcctaagtgattctcctgctttgcctcctgagtagctggtactacaggcatgcaccacaatgcctggctaatttttgtatttttagtagagatggggtttcgccatgttggccaggctggtctcaaactcctgacctcaagtgatccacctgtctcggcctcccaaagtgctgggattacaggtgtgcaacaccgtgcttggcctgaagaccttacctaacttttctgattcttacttttcttaaccataaagaagacaaaacagtttctacattccaagttaattttgactattaaagaaataatatggaggaaggatttttaaatttttaacggttgtaaaaatacgatttattcctttggttttcttttcccaatcccctagtaccttggaggtagcgaatctgattccagtttccatttccatgagataaccgacaatagaccagatgagctctgactttctcagtagcaatgttaacagtcataacgatgccagtaaaaacaataataattatgcttctatgaacaactcacattcactgaccactaatatgtgccagtcactttccttggattaactgatttaatcctcacatcccctctgtgggtagacatcattatcattttttggatgagaagaccaaggttcagagagcttaagtaacttgtccaaggtcacactactatgaagaagccccattggggtttgaatttacctctacccctggagttgcgctattgaatacagtagtcactgattatgtgtcatacagcaccttaaatgtgattggttgggatgcgctggattttgaatacttaatattttaaaaatgaaaacatttcattaatcatggtatactgattacatattttggatatactggtttaaataaaatatattattaacataaatgacaatttttcctttactttttaaaacacagctactaaaaaaattgaaaactacatctgtggcttgcattatacacccattggacagcactggagtggagcaagagctctgaggccctgccccagccttcactgggcctaattctaaaactgcaccatgtacagtagcaacagagaacagcagacatttgctttttctctttttttttttttgagacggagtctcactctgttgcccaggctgaagtacggaggcccaatctcggctcaccacaacctctgcctcctgggttcaagcgattcccctgcctcagcctcctgagtagctgggattacaggcacacactaccatgcctggataatttttgtatttttagtagagatggggtttcaccatgttggccaggctggtcttaaattcctgacctcgtgatctgccggcctcagcctcccaaagtgctgagattacaggcgtgaactaccgcgcccagccagacatttgctttccataacatttatggggagcaggggtggaggaagggaccaaatccatatttgtgtggcttccagaaagctacagctttgcagatttatcttcaccaagagagggatctgcttcttggggctatgacatgtgtgtctctaaatatcctggtggttgaatccagtctgaaagcaaacatttcaaagcctttggcagaagctgtttagagacaggctttcaagccatcaggccagcagatgatgtttacttcttatgacaaaatagtgaagtcaaaattgtatttcatagcagttacttttatgtcctgagaatagaaaaatcccttccaatgaccaaaacacccctgcacaacctcaaatcccattaaataagtctgtggctttgccactttgtggaaaacagtgcttcatctttccagtccagacaggtccttaacctcctgagatacttcttgcattagcagaaggtgagtgtgtgtgtatgtgtgtgtgtgtgtgtgtgtgtgtgtgtatttctctaaacagactgattacggccaggttcaaaggtgcaccaccatgttcagaagggcaatttggaaggcacaatgttttcctgcaaaatggttggctggcaacaaagactggaagaaacaatgagcaatatgcacctcgcacaaagggctttgcacttcctgaagttgttctgcactcacgatttcactggcccctttttcacatgtggatgagggagacgaggaaactcaggccaggcagagtttctgcttagcactagggtgaaaggataagatttggaatcagtgggctcgcacttaagtttttgctctgcttttctagctgtatggccctgggcaagttaccaaacttctccgcgcttgttatgtcttatttgtgaaatgtggctaatacagactcaaaaggttatactctatgatttcattcctatgacattttagaagaagaaaatctctatcagaggtttccaagggtcagggctgggctgagagaaggcctgcctacaaatctttagcacaaaggaaagttctgaggtgacaacggttccgcatgttcatcatggtagttaggaaaacccagaagtaactgtacagcaaaaacaaaaagtgaattttactgaatgtaaattcagaactatttatccgataaaaaaataactagactaaaaaaaactcctctctggaaggttgctgtggcatttgagtttatacagtaaacagcagggaaacaactgaaacctacttcttgatattcctactctggtatttctaggtctgccactgccaaatagaagcataggaaatggaatcaaccaaatttaatttcaactctcaaaagcagtgaagaggaaagaggctcatgatccagggctggaactggaatgctgatgtggtgacagctgagaacaggtgggagatgggaactggcaaactaatctgtacgtgactctccctgcacggtgaatttaccactaagagagtttgcaaaccttctccctgtcctctctgcttgtccgtggtgttcttcagtgtaccccagccccagctcttccttgccccactgactctaaactttctcaccgtttcacacagatctagttgtgtcttggttatttgtttcaggcacgctgccagctggcatgctctgtctactgctacagaaaacaaatctctcctccatttctcatgtgttaccagcctaacaaatacactactgtctatgttttacactgattcgtgcaaatgacctggctcttttcacgcggagtgctttctgcaggctgggatttaaaaaagatggtgtggtcctctgcctgggcaaagagtatttttagccgctaggttttagttaattacactagctgttgctcatcatggctcttggtttcttttgtgttgctgaggggagcggggtcagcttctgaatctaaagcatgtggctttgaaacataagtaaatctttcttcagggtcccagctctagttctcagggatttcctcattgcattttcatttttaggatgttctgaggttgttttttttcttttttcttttttttttttttgagcctgtcacccaggctggagtgcagtggcaccatctcggctgactgcaagctgcgccttccgggttcaccccattctcctacctcagcctcccaagtatctgggactacaggcggccgccaccgcgcccagctaattttgttttttttttagtagagacgaggtttcaccttgttagccaggatggtcttaatctcctgacctcgtgatccactcgcctcggcctcccaaagtgctgggattacaggcgtaagccaccgtgcgcatccatgttctgagtgtttttgatgcgtttgtggtgggatgcgaggagagaagtggtttcctcctcacaccttgggttcttttctatctttgcttgggaaattggcttttatttgctttgtagcctctcctctccttcctgttaagaaagtgattatccatgcacaaaatggaaagttttcaggctcaagcatgcttgtgaaggggagttggagatttggaattgttttggtgacctccaggaataaaactaggaaattcaagggagctggtttgtgaaggcttctaattagaagtgccctcaaatgccttcatatgtagtgatgtccctatcaacagaggcattcgaaaggaggctggagggccacttgctgaggatacttgagagaagctttatgcatcctagaggggttggtgctttcagagttctcctaagctcaagcctctgtgattccacatgactccttaacttggaaagtaagacacagacacagaaagggcatacaatcaaccttttctggaaataggttaaaacagtgtaggggccaggtggaataactcacacctataatcccagcactttgggaggctgaggcaggaggattgcttgagtccaggagtttgagaccagcctgggtaatagagtgagatccaatctaaacgacacacacgcgcgcgcgcacacacacacacgcgcctgggcaacatggcagaaccccgtctctacaaaaagacaaaaattagccgggcatggtagcgtacgtctgtagttctggctactcaggaggctgaggtgggagcatcacttgagcctgggaggtggaggttgcagtgagccaagattacaccactgcactccagcctaagggacacagtgagaccctgtctcaaaaaaaaaaaaaaaaaaaaaaaagaaaaaagaaaagaaaagaaaacctgaaactaacaaaaaacagtactgggctggatatcttctgtctgtctttcttgcttgttctactttccatccttttagatttttccgtgtcctgagaggctgacacatatgggtcacttcaacaggctcctgtgccctctggcttccaggggatttcagccactggggaacccaggaagatgatcggaggggaggtggacagtgaggtcggggatttttctcatctctttctctatggatttgggacatggtgggtaaaatatctctctctctctctctctctctctctctcactctctctcccgtttctatcgccttccctgtctcagttccacttccttctcatgtcttttcaggcctagggatagtgaaactctcaacttattcagtgtgagtaggccatctctttcttggcaagaccctgcctgacacaaatattcaacacctactctgtgcaatggaaaatatggcatagttctttccctcaagtgctttccaggatggttatggagataggatgaaaatcttgggagaggaaacagatacatttttgttgtggtggcttttgacaccatgggctctgtaatcctaggacataagaactgtgcctatatacatgagctaaccagacgaaattctgctaaaaatcaaacagaccaacgtttccatgaattcgatcaaataaatgtcttatttcttggctttctgacaaagaattgaccgaatattccttctggatgagctgtttcagcatagtcttcagacatggcctctggcagcatttgtggaatgacaaagttaactttgggggaatgacacacaatggggaccagtggtttctggcaaccccggtgtgatctgggagggtcaggatcagaggatgcatgttgcagctggagcccaggataaggttagtatatcacactgtgggacccacagagctgcctggtcacaaaacagaaggagtctgaatttccccaagaagagggaggcgcctgcagaatcattagtaggaacagaaagccagtgccccttctgggaggagtgagcggggaagaaaaatgtcctcatgtattcatgaaaagacaaagatgcacacaaggcttcacctttataccccactttatggaaatgggcaaagtggtttgtacatagagcacaaaaaattgcgcacgggtagctttgactttctgtcacaaactctcagttttcctttaaactaaaatgtgtcaagtcaggggctgtgctgcatttgttcaccttatctccaggtcttaacacagtatctgatccacagaaagtgtttagtgaatcattgtggaatgaaggtagaattgctacgtcttccttcatctaaagcaacatttctcttattcatcaaattgtacgattttaactccccatctctcatcatttctcctcctatttctaaggagttctacctcctatgcaaagtctgagaatcccaggggtgttcactggcataagtgagtactgtcctctacaaagaagatcttggaaaatatcattgatctatccgtgatgctcatgttgtgctactgttgttattgctgccacatagtatggctcttgagagcaaaggtccagaaatgtggggtagtcttggaccacagagaaaaattttccaggtatccattgctggcccagtagcaatcttgcttggtcttagaaatggggaaataggccgggtgcagtggctcacgcctgtaatcccagcactttgggatgctgaggtgggcggatcatgaggtcaagaaatcaagaccatcctggacaaacatggtgaaaccccatctctactaaaaatacaaaaattagctgggtgtggtggcacgcccctgtagtcccagctactcaggaggttgaggcaggagaatcacttgaaccagggaggcacaggttgcagtgagctgagattgcgccattgcactccagcctgagcgacagagcgagactccatctcaaataaataaataaataaataaataaataaaaaagaaatagggaaataaaggctttctctcccttggttaaattcatcataatctattctacacaaactagaagagcgctagacccttctttcctggtcactttctatctcctaaccctgtttccttcatggtacttatgactagttgaaactatatttatttgttatttatcctgtctctccttctctagaagctaagccctgtgggagtagggaacaacagtatccccagcacctagaatgttctgggcacatggtaggtacttagtaggctttgctgaaggattgaatgaaggataggtcacttcatattggggtatgggctcccaataatatatgtaattctttaatatacagctcttttaatatgtgggcactcacacattcttactccaagacaatgtttggataaggagggattgctaacttgcagccacatatcatgttcagaactaacctacccctccgtggaaaacataatcctgctttgaggtgaatcaacgagcaagttatggtgaaatttctcctgtgctccctggcctcatctgatccatcctagtctatcagaaatactatataaagcagaacctcagaaggtaagaggtatcactgctttttcccaagattcccattgatccttaagtcagagatgactacttgtctaccaaaaccatttcgctaactttctgcacccaaggtggactgactacctttcccatcctcacatgcagagaaatgtctctgtgacagtcctactcaaggtaatgtgggcagaagtgatgtccatggtgaaaattcttttctttgagtctacgagactgagaggatctggcaaaagccacagggcatggtggatccaagatagagcttggatctctgatgctgtcctcctgaacattaatttttatgtgagtgagaaatagaacaattgacttgagccactgagatgttcagatttatctgctatggcaggtaggtagttgccctaatacagttcctacagaaatttatcccctactccattagtattctaggagctttacagaacaggagacatgggggaatgctagtcttaagccattacaaagaggctttacttgccttacatctgctaactccaaagggccaatcagattctccccaagaaaagaaaatgtgagtggatgtttccaccactacaaacagaagcttctggaaatgtctacatgaaaaaaatttttttaaatctcattggcacctcactgctaatgaacaaaagtacacacattttagtgatggaaatacctgctgtgggatgaaactgtatgatgtagcagaaagcattttcggaccaagagacttaaaacctatttttaatccttatggttctgtcttaacaagctgcatgaagcttggacccctctctttacctctccaggcttcatgtggtattaaaaatgatccatgaaggtaaaacacattaaatggttcaggttttgtatactgtaatgggatgggtaattcaattcaacaaaccttgattaagatatgttggagatggttgatctaaatgagataagatgtctgggagcagtggcttatgcctgtaatccaagcactttgggatgcagaagtgggtggatcacctaaggccaggattagctgggcatggtggcgcatgcctgtaatcccagctactcaggagactgaggcaggagaatcgcttgaacctgggaggcggagattgcagtgagccaagatcatgccattgcacttaagcctgagtcacagagtgagacctcatctcaaaacaaaataaaataaaaataaaataaaataaaataaataagatcagacatagtctgacccccaagatcttccagtctactggaggaaacagatagttgaatgacaaactgtaatccctaataagctgaaataacagcaaactatcagcaatgcaatctgggtgtgtaaaagcagtgattacttttgacctggagaatgaaaaaggctttaacaatattcctaatgttcttaagaaaatgggtaaattttctaaacaggacttacaaagacatgtatgatttgcccccaccaccccattcctcccatgggcttctttggccttctctcttgctggtacatatgcaattttctgtgctccagtgatagttacctattttgagttcttaaatttgccacattctctcctccaagtctttgcaccctcctttatcacttctgcttccattgcataatgtgtactatcttttatgctttagttcatgagtcacctcctccgggaagcattctttgactctctcagttcaggttagaatcctttgtaccacttagcattctattagttgtaagtaacagatactgattaaaatggtattaaaacatgacaagaaatatggagagacacagagctaggattaattctgtgatataacaatatcaagacttggattcaacttttctgcagttctcttgacttttgcctcatggtcacaaaatggctgctgtagttccaaattatggcctctgacaaaacaaccaagattaggaaaaaagtaaaataacttgtgttgatattactcctcaagaaaaatccttcccagaagtgtttcaaagattttctcatacatctctctggccagaaggggcttatatgttcatgtcctagctgcaatggaggccagaaagtgagagtctgggatttccagagaaggaggtattgcaagtttggaagaaataggatatgcgagactgttgtggaggtcaaaaacagggcctccctctgaactgccacagcccccgttcccactatggctcatcattatgttgtatgtagtagtttacttgactatatccactagcctacaagctttgttagagaaggacaattgtactggatgaatgaaaaagaaacagcgttattatcaccaacccttctaataacaaaagtaacaaactgaaatcacttcagtctgtgagtagtaagtcttcaccgtgcagaggcttcctggtgagatcctatccggtaagacctcaacctcaggggctactattgatggacaaaacataacaaagtacaattcccaggcctctaccaggtggttaaacaaggtgggaatagtgaaagcagaaaatttgagaactggtagaagcagaacttcacagctgaactggtccggtagagaccaaacaggaatgtgtaagactgcggatttattttggttgcaagaaacagaaactaactaaccagttagttgagacaataaggaacatttttactctgtccataacaagaagcctcaaggtaaggcagctgagggttaattctgtctcgtcatctatagcttggctttcccagggttgcaaggtggccaccatagttgcaacctctacatcaacaatgttcgcaagatgacacatttccccaatgcctctttttaagggaacgtttaccttttccagaaatctccagaagaatttatttctctttgggcagctctgggttacatatttatctataaaacaatcactggtatgtataatgagataatcataattgaattaaaccaagcaatgttttcttaattacacacggacatcccaattttattgtgtataatgaagaaaatcttgttctcctccaaggaaaaacaaagggaagtggaatgactattggataggtagccaatgacatctgttacaaaaggttaccttggaactaagcaaattccagttttcagtgagtaagtcttacaaggctgaatctcaatccacacctggcactgcaaaaaccctgcaaaggaaagaataacccaggttagaacgtttgtcaactggtttcttctgcttctgtcttatatagagatgcttatcattcttcagaattcctaggacatggatacagaataatctacgacattcacaacctctgggttacctctttgcagatgggccagttttgtcatttctaagcaccaggattcatgtatcctgagctgtttcaggaaaggaagacacaggcccccgtctctacgcctgtgctttaggtctgagcctgcatcctactcattgatatctaagcagcatctccctttctaccttatcatttagaggaaaacttccttattccagatatggaactcactttggttgttctcaaactctgaggcaatatcttcattaaaagttttaagccaagagaagatgtttcccaccaggtggaagcaaaacagcttcagaatagatcttggtccagctggtcttaagggacaattagcgttgtttactttccatgacccaaggcatgtctaagttcaggccagtaactacttctaagctggaactttacccatggacaccaaattattctgctgcctagtcatctgggtcccttttattagatgttttgagattctaagtccgggctcagtggaccaaatctggcctgccacctgttttttgtaagtaaagttttattgggacacggctgcacccattcatttacatatcatctatggctgcttttgatctacaactgcagagttgaatagttttggcagagatcctatggcctccagagcgtactgtctgggtctttgcagaaaagtttgctgacttctgtccaagggggaaagagcaagtgaaaagcatgaaggttctaagcgggatagatgctccaaattcatacgtaaacactaagcaaaagctacagagatgctagaatgggttcagatggtttgaaagtcagcacactgggtcaagctgggtcttacgaggactctgctcagccagtgatatataatgggcacctcacagggagctgagccagttccatgtctccctggaagaagcattgcacttcacaagtgtttatgttctcaaatgtgaaacctggagacggttttctaaataggactttaaatgctccagtctgggtgtttttgcaatctgacacacacatccattagagctgctccatggagcctctggactgaccgtaaaaactcagccacagacctccttggttttcaaacaggagcccaagaaagaccacaacagaaacctgtttatacagttcaggttttcttagtaacacaaggcagaggtcagacaagtcttaatcacttgctgtaagaattgatttctgctggaacctaaggcagacagacttatctgcttagggttgtggtttcttatcccttcttaataaaaaaataaataaataaaataaagccatggaagatggctggatgtggtatctcatgcctgtaatcctagcactttgggaggctgaggcaggtggatcgtttgagcccaggagtttgagaccagcctgggcaacatagtgagaccccatctctacaaaaaataaacataaacgagccaggcatcgtggtgtacatctgtagtcccagctactggggaggccaaggtgggaggatcacttgggcccaggaggtagagcctgcagtgagctgagattgtgccacctgtactctagcctgggtaacaaagagagtgcttatctcaaaaaaaaaaaaaaaaagaaagaaaaaaagaaaaagaaaagaagccatggaagataatattaatcactcttgttttagacactgcgctaagcgttttatgtgcattatcttacttaatctttacaatgctcccgtgaagaaggtactatgctatatgacctcctttttagagatgaggaaggtgaggcctagcacagagttccttgagtctggtgagcttgtgaaaatgcagatcactggccctaccccagggattcagattcagcctctctggggtgggacctgagattctgcatctctaacaggttctgaggctatgcccatgcttccggccagggctgcactgagcgcactggcctagagtttaagggaaaagctaactctcatgaccatttgtggcaggataagctctcaaacccaggtttgagcatgtgacttttcattcttttaatcagttttcataaactgcctcccatgagctccgaaaataagtgagtgaaaggcatttaaacacacacccaggaaatcaggtcagaaactcagtggttgctatttctaaaatgacccaaatctttctcaattcgtgtctcgaaattttggccatgttgggaagtcatatttgaacaatatataaccacacaagcatgtaaataattaaattggaactttggcctggcctagaatagtagatctgctaatcttctccaaattattaattctaagaagtcttacccaaactaaccttgcctccatgctttcttaatgtactctcaggacttgagaaagagattgttgccacacaatgttgctcaatagtttcagctctatacatcaggctttctcttctcataaagatcagaaattgcttcaaggggttattttccctgtcttaacatcttaatgctgtattgtgcctgagtaaacaatattcaaaatgctatatagtatacagaatatctggcagtatggcataatgttaagaatgtgggttttgcattcaaactttgaattcacatacaggcaatgccacttactgtgtggttaagttcctaaactaagtctgttttcttattagtaaagtggagaccaaaatacccctataaagttgttatatcacatgtaaagcactcagccatgacatatggagaggcctaaaaatgtgaattacaaattattgtgtaatttattatatatacaattagatcatataagtatatatttatatcttacaattatatattgttactgtagtaacataattaccttactactatattaatgtaaaattaattatatagaagaatcattatattaatattaaccaatatattattgatgtagattaatattgatatataatgtatattatatataattatttataattgtaatattttataattgtaaactttgtttaagctctagaaaaatgtgttgactaaatgcatctttctttgttgcttttttttaagacagagtctagctctgttgcccaggctggagtgaggtgtcaacatctcagctcactacaacttctaccccctgggtttaagcaatcctcctgcctcagcctcccaagtagctgggattacaggtgcacaccaccacgcccagctaagttttgtatttttagtagagagggggtttcaccatatcagccaggctggtctcaaactgctggcctcaagtgatcctcccacctcagcctcccaaagtgctgggattacaggcaggagccaccacacccggcttaaatgcatctttgaatctagtcagttttagctgaagaaacacacagccgtggatatgttagtcaattaatgttagctgcagacaaggctgtagtaaagaaggttccaggcttactggcacatatccctttgctaagattattttccttctggaataacctcttcttcactttttgcctatccattcttcaagtctttcctctgctatgaggccttcacagatgaagctcatactctctcatgtccatgaacacaacaccatttggtcaattccacagatgaatttatactcccttcaattttttcctgtgtacagccttgttctcccagccagaatatattctccttgagagcagttattcatgtctgacttgttttgtacctgccagactactcggtaagtacttgaatacaagcacgggaaaaaacaataaatttaaatatatttattgaaaagaagcagggtctaaattgtgatgcaaacatgttaagcccttgcagaataatcattagttctattttgcaaaataacattgcattcaaaccactacaagtacaaagcatggttgggctttatagctctaaagaggctagacagagaaataatgaggccattctactgtactgcccacagcaacaacacgatttggcatacactggagactggtggtataaacatttcttagtccagatcttaaaagggactgtaatcctaaactcacctctcctttaacaaagttattatgttttggcattaggctagattaaaatatcatatgaattgagcagctgaagcttggatctggtaaagggggacattagggtgatgctctgggaagcacaatgaactaaaaacctactggtagacaaggttttgtattttaattcgaacacttggctccttatgtagagaattttcaactaacttgaaaaattgctgttgagacaggagcctggaacatctgatggcagtggttatgtgttcacggaaaaatcaacactaccccctggactgatgtaatcacgttgcttagagtcacttgaatcaggatctgctgacccatcttacttttttgcccgtagtggtggaagagagaagtttcactgtatgtgacaactgacaagtagggaggtgcttctcaaactttaacatgcacgcaaaccacctagggatattgttaaaatgtagattatgattcattaagtctgaggcaggacctcggagtctacatttctaatatctcaggtgatattaacattcctagtccaaggactgcgctttgagcagcaagtaggtagaggatgcgggaatagttaatacattgctgcatacaccaaccagcctcgatgcaatgaggaggcatctgcgctgttttaagggggatgtgtattagtctgttttcatactgctgtgaagaaatagtggagactgggtaatttataaacaaaaaaaaaggtttaatggactcacagttccacgtggatggggaggccacacaaatcatggcagaaggcgaaggaggagcaaaggcatatcttacatggcggcgggcaagagacgtgccaagccaaagtgggaaaagccccttataaaaccttcaatctcatgagaacttactatcaggagaacagcagcatgggggtaactgcccccatgattcaattacctccagctgggtcccccccatgacacaaggggaaaatgggaactacaattcaagatgagattcaggtggggacacaatcaaagcctatcaggatggaaacatgaaccttctagaaatgaagatcagggaggaattcagtagactttacaatgagcatcatatctagcatcctttgtcagagacatcaggttcactagcccaaaggacactctttcctttctaaatcttcaaagtagtgactttagagaagtagctagttaaaaggatggcaaaagagtgctactacaggcagtgcacatgagcctggagtcagacagcctagctctgactcccagacctgccacacagtcatcggctgtgatcttcggaaaggcgacttttctccctaagcctcagttcacataactggaaagcagagataatactcgtagggctgttgtgaagaccccagaaggaacacatataaagcacttcattctatgcatggtgcatactagtcaatacatccaagtaatttttttaaaaaaattagaaaaccaatcaatcagtcaagagtgattgagtacttgtttgttggacactgtcttgaggcagtcctagggaagaaagagtaaggaagagagaattaagaagaggagaaggagacacaatcacaggtctcaagtaaatcccagaatatacgtggagaggcaaacacatacgcatgtggaattatttagtatttccacagcaacacgccaagacacatcacaaatagagttatagagcacacataagccatttgaagaaagcaaatgtttaaaatgatatcactggagacaggaaactgaaggagtccctagacaaagtcagagctgtattaagtttctttttttaatgtttcatttttcagcaggatattgacaagagctgctgtcatatggaaactattttttagaaacacctggaagaactaatttgggggattgaattttttttctttaacacaggcttaacatataacaaaatacaaggtgtgtctgagatgcaaacctggtaagagattagatcatcaaagctaaattaccttaatttccatattatttctgagaatagcttgaatagaccttttgggtcacaagccaccatttgtgaagaactcatagacatttttgtaaggctcacaatattcaaaaggctattttgatatttttctcataaagacatctctgcaaaaaaaaaaaaaaaaaaaatcaaaagaagaccaggagcagtggctcacgcctataataccagcactttgggaggccgagatgggtggatcatgaggtcaggagttcgagaccagcctggccaacatggtgaaaccctgtctctactaaaaatacaaaattagctgggcgtggtggcatgcgcctgtaatcccagctactctcgaggctgaggcaggagaatcgcttgaacctgggaggcggagcttgcagtgagccgagatcacgtcactgcactccagcctgggtgacagaacaagactccgtctcaaaaaacaaacgaaaaaaaaaaaaccaccataaaaccaatttaacacttactggtctagaaaaatcagatctgttcatatacatgggtaaaatggtttttagctatccaaaactacaatttttattcgtggcatgtgtgagtgctgtacaattcacataaatcccatatttgattctcacaagaaacgtaagacacaaggactattatcacttccactttatggatggtgacattgaaacgtagagacgtgtagtaacttgcctaaagttgcacagctaggaaaagatgtagctggaatttgaactaaggatttatgttgttaaatctactttctctactattcttaccatagagctgtatttagcttcataagtgtttgttttgggggaaggttgcatgtttctgatttatctttcaagaatatttgcccaaatcagtgactggacccaaaaaaagagctgggattatgtcttcgtgagctcaatggatacataagaatgctctttttcaacagcaggcacatgcgatctctatttgaccaccttaatgtgattctccctagacaaactctttcctctttatttttatttctgtctcccatacacattttctcagagaacaacccagtttaccacaagcctgaatgttggtgcaagagcgtatctagaaagacccaatatttgagagacttcattctattttcccatctccacgtaagagaccagaatgtcaatgtcatggtggagatggaggtgaataggggtgtggtccctgtctatacctccagcaagttatgtaatcaatcatgacccccaagatttgtgaccttcttaaggaaatgatgatgcccttctcatcattgtaccttctagcacagtgcctagtagagaatcctcaaaaacgattggatggaaacttgggccagtgtggatcactagaacttctgcagtgatggaaacatttattatttgcattgtccaatatggtaacctctagtcgcaggtgactactaagtgcttgaattaatggctgctaaggaacttattttaaatttttattttaatttaatcaatttttaaatttgaatagacccatgtgactagtggctactgtactggacagcccagtcctaggctataaaatcaggaaaataattccccatctgtttatcttacagcttgtggtgaggaatacatgaaataatgaataaattaaagatagtatcatatgaggaaatcagatggtttggtttaaatcccagttccattaccttctatctctgtgacccttgacaactttatttaacttccctgagcctcagttttcttatgtgaaaaatggatttaatgataactaccttttacagggtagttaagtggattaaataataggtatgaaaagcctagcacatcacttgacagacagaaagtgctcaacaaactatttttaaaaatgagggtattttggaatgcacagagctctgtataggggcgatatatgattattagcagaaaatgacaggacccgtgtttgctcccctaaactgtgtcttcttctctggagaggacatggctgtgttggcttctcccttttcacagccactttttggtcatatactagatagctcacaaatatctgatgctttagatgcatccctgaaataattctctgctcctggaatagcttggctttcctggagtgacatgcatgctgtccctgtgccaccgaggaggtcaggatgaggtctgctcccaggtctcctctgcctgcctcctgacactgaaactttgcagagaacaactttgtctagacaagcagtggctcgtctggctgctgcagcagctagcatcctcattgtttctctctgtgttggctgcaaattcctttttctgtttatcccctcaggagcctaggctctgggagtgtagcatgggggttggagggagaaaaagcagacgttcccaagactgtcattgccatgggcaccagccatgtttgtggtgctgttactgatatggcccagagatggcatgaacatcaagttgtcaaggacagcctactggttctagttactgaagctaccaccaatgttttacagtggattccctgccagccaccagactgggaaacttcaaattgtttaaaagaggcacctcctatcccccagcctgatgctggagcaagagagctactcacagtgcctgaaatatatcctggttctcatttttcctctgctcttaactctacccagagaccatcgtgcagatctattctgcaggtgggaaatggaggcagagcagaacagactcgcagacttcgatcattccttcaacgaacagttgctgagggcaacaatcccaagtgctgactgttgcagagcgagtctagaagccaatcccttggaatcttaatatatattggcttgtggccgggcgcggtggctcacatctgtaatcccagcactttgggaggccgaggcaggcggatcacgaggtcaggagatcaagaccatcctggctaacactgtgaaaccctgtctctaataaaaatacaaaaaattagccgggcgtggttgtgggcacctgtagtcccagctaccaggaggctgaggcaagagaatggtgtgaacccggcaggcggagcttgcagtgagccgacattgtgccactgcactccagtctgtgcgacagagcgagactccatctcaaaaaaatatatatatagatatatatatatgtgtgtgtgtgtgtgtgtgtgtgtgtgtgtatacatatatagatttgtttatttacaatctgcccctgccaatagaatgtgagctcgtggagctcgtggagcccaaggattttgtctaccactgtaaccctaaagcatggcatgtagataatccttaatcaatatttgttgaataaatgaaggactactctttcctcatcgatgagtcttttaaacaaaacatgtacttagaaagcccgtgactatagctcttcttccaaaagtaccagctctattgatgtggcaaacacattgactcactgactcaatatttgataatcatttccctccttccttccatcccttcctttctttcctccattcttctcttgctcactttttcattcatgtaatatttattgaacatctatgattggcaaggcactctgtagtgtacatcaataacacagagccttcaacacatttgtctttgcttatctagtgtgtttggaaaaaaagaaaaaacagaaatagagacctttctgttgtgtgaaggatgaagatttattggtgcttggagaaattgttgaaagatggaattaaaactagagacacaagttgaactaggcagtttacagcgacatcctgaaaatcacctaagggaaaaattgtaaggctggaagggaagatatagtcttactgtgatgttttcatggtaggaatatttcctggactaaatcacaggtttaaaacacacaacacaaatccattctactgcaaagacaaacttaagttcatacgatgtcagctggcagtataaatagtctggaatctggggtgacaaagatacagagtacattggtctaaagcaagggtcagcaaactatggctcatggaccaagactggcccacaacccatttttgtaaataaagttttatcggaaggcagtcatgttcatttgtttataaattgtctatggctgcttttgtgctgccacagcagacttgaatagttgtgacagagaccatatgacctgcagagccaaaaacatttactctctggacttctatagaaatttactgattttggtccaaagcaaagatcctctcatgccaaatgagattctttaaaagaaaacaagtctggacacggtggctcatgcctccctcactttgggatgccgaggtgggtgggtcacctgagatcagtgagtctctcactgaggtcatgagttcaagaccagcctgaccaacatggtgaaaccccgtctctactaaatacaaaaaattagccgggcatggtggtgtatgcctgtaatcccagctactcgggaggctgaggcaggagaatcgcttgaacctgggaggcagaggtggaagtgagtcgagattgtgccactgtactccagcctgggcgacagagcaagactctgtctcaaaaaataaataaataaataaataaataaaacaaaataaaataaaacagtcctcacatttagcttggtatattgatgtttatacacctgctttccctaccaatgaaaagcagtccacagttcatatcattacatcatcaaccccaatatgttattgttctctctttctgcaatagggctactaagctaatgatctgagataactttccataagtgaaatactgaacggtcaaagtatttttactctaggcttcccagaccactgcccttttgttgtctcatgccagagctggataaataatcagatcaattcatgtttgcattgaggcttgatttggcatacggcagccttataactgaagatttcttcacctgtgcttgctttgtggttacagatctcaaaatgcccataaacttgattaaacttgtcccttgtatgcctcctcatttcacatgcagattgtttgtgattccgagttacataattctcagtttctcaataaagcaaccagcaggtggtatgcctttttgtttgaagagttacctccctgtgtaaaaatgtggagccaggtgtctctcactgagttcaacggatccaagcatttagacctcctaggactttcttaaaacctagccctgattttttttttcatgtaaaataaatattttgaaagagggaccaaagcatttgatcattctctcttcagttactgcaatgcaaaaactgaaaaatgggatccttttcgctgttctggtaataagaccttagtgaaagataatcatttaaacagcagtttccagatacacatttactataatcctcacaatccaatagagttatttttacgcttttacaaatgagtaaagtgatgctcagagttccagtaatttacctaaggacacacagcgattaagatagagggtccaaacctatactctttctactctgctattcttcccaagaaaggcatggaaataaggactacagagttctctgtgatcattacctacagaaatggtggatttctctacatttcttatagtccagtaggtacagaaccctattactaatgaaagttggtttacctaatcttaactagtatgcaatgaccaattatttttgttgttatttcaaatgaaaatgaagatggtggacatttggaaggtgatggtagaatatagaagaaagaataaattaaatttcattttcactggagaagcactataaaggaataagctagatctgaatgagaaggtgaggcatagtcaaagttacctttaagaacacaaacgtacttagggaggctgaggcaggaggattgcttcatctcaggcattggagactagcctgggcaacatagcgagatcctgtctctacaaaaaactgaaaaactagccagatgtggtggcatgtgccttagtcctagctactcaggaagcttaggtgggaggattgcttcagcttgggagtttgagaccagcctaggctacatagggagaacctgttgctacaaataatgataataacaataacaagccaggcatggaggagtgcacctgtagtccaaactacttgggaggctgacgcaggaggattgcttgagcccaggaattcaaggctgcagtgagctatgatcatgcccctgcactctagcctaggctaaagagcaacaccttctctctaaacacacacacacacacacacacacacacatacacacaagcaaacattttttaagacaaggaatgtttattaattgactcttacctaaagcttgttgatagcttttctataaagcccctcctgtcctgttatccctgttgcctgttttctcattcattcacccatttattgagtgctgactaaaggccaggctttatgtgagatcttgggactatcaggacaatatggcctgtatttgctctctggaatcttgaatttagggcctccatgttgaaaccatcctcctcatttccccactgatgaagacaaagaaggctagatgaagaactactgaaatacaaacacaaacagcatggcacatagagagaagcttgtccctcactttgaagttttatcctagagattttccacaggacatctctttctgtctcatcatgggctctttcttatctcctgagcccttaaaaccacaactccaagttcagcttcttttgatctgcggggatataggttaagaaagagatggggagtagctgcttatttcagcttcccaggcaacccaaaggcagggagaagacgcagaaataaaatattgctgcagcaagttaaacctgcactctcccttctaggcagtcatcctcatttaagggtcctaggaagattggggtcagtgaagatgatatcctaaacatccaattctcattaataactgagaccattttattaatccattctttaaaacctttaaaaacgtatattttaaaaataatacatgctgatagaatgcacaacaccaagagtggaccctgatgtaaactatggactttaagtgataatgatgtgtcaatgtaggttcattgattgaaacagatgtaccactccaatgggaatactggcggtggcggaggctgtgcatggggcagtttggtagagggtatatgggaactctctctaccctctgcttaatcttgctgtgaacctaaaactgctctttaaaaagtctatttttcaaatgtcatacacattcataggctcattataagaactttaaaaagttgtaggagaatacaaagagaaaggtaaaaatcacccagcattcttccaaccctaatgtgagatgagtaggattaatgatttagtaaacatcggctgggtgcagtggctcacatctgtaatcccagcactttgggaggccgaggcgggtggatcacaatgtcaggagatcgagaccatcctagctaacacggtgaaaccccgtctctactaaaaaaatacaaaaaattagctgggcatggtggtgggcgcctatagtgccagctactcgggaggctgaggcaggagaatggcgtgaacccgggaggcggagcttgcagtgagcccacatcgagccactgcactacagcctgggcgacagatcgagactccacctcaaaaaataaataaataaataaataaaataaaataaaataaaatgatttagtaaacatctcccaaggtttctctgaccttacccatacgtgtacaaatttccataaacagggatcatgtgtttgtctatttgtgtttcactcagcatgttttcctgtctattagtattgatccacatggtttttaataagttcatagtattgcagacataaatgtgccataatgtaccaaatcattctcttatttgatagccactttggatttttgctcatacaaataatgtgacatgaatgtttctgaacataaacctcttgcctattccaatattctttgaatctgtgtatcttcccagtccctagcatgttttggagaatgttctgaactaaatattcttaatatgaatgtgaggtggttcttctttacacaaagtacacatctaggcagaggatctttattaattctacttctgacactcctattggagaaaaaagaggaagaagatttgactgtgtgatcacatctgtaatgtctttagtcagggccttgcacatagtatgtgctcaataaataatagctgtgactattattgttgttgatgttatttcttttgcttggtccaagtgtccttcctgaaaaagacctgaacacggcatagggtgacctgaacaacagaaaatgtgaagaaaactacatttgtagtcactaaaagtttctgactctggctgtaattgtcagttgtagaaacaactaatcacccagagaatgcagttcactcaagcatcctctttagacatacagtgcaatggctgtgaaacggagacacagaccacatgttccatggaagccatgataatgatcagatatatttactcatttgtgatgaagaaagggagcacaatttttctggcttttgacacattattatctcggttccaactttcttatcccaaggaaatagtaagacatgttggacttttatcaatggcattccctgtcagatcctgtgggctaccactccatgttggatcactcccagagccttccacaaaagcctctaaaactgtctgctttaaacccttcaattataaagcagttaaaaaaacaaaaccctcagacataactgcttctgcctaaatctaccatgctgtttgtaagactgtatgtttatgatatgattttgaacatcatcttcaggaaaaaattcttactggtttatgctcagatttatgggtctattctttgccccaaggtgagatgaaagcaaaatcaataaggttagttttggattgcttgaagtaagtaacacaagccaattttcagtaacctcagatcagtgaagtaggagaaaattagataaagagagaaaaatcaagagggcacgcttgtgtctctaggcacatcatttgtgtcgatgacagaattcatttaaaaattataagcaatcgtgttttagtagcattagagaaaacagcataggttgtattaaatttgatactagaagtactagaaataacaacaaaaatgttttgccctggcacctccctgacccccaatcagtaaccagcctcattagtcatggcacctctcacatgaggcccctatcaccgctttcataaatatagtaagattctctgaatcaaaatcctgtgttgtctcaaaaaataattataaataataattatgattatcatttattgagcacctattgagtacctggcaccgtactaggtcctttgcacatatgagtcaataaaaatttactgagagcctactatgtgccaggcattattctccatgctaaagatacagcagtgaacaagttacacagagttcctgctttctgaaggcttccagtctgagacaatcaatgagcttatgaacaaacaaacaaagatagtaagtgctatgtagaaaactgaaatagggcaacatgatagaaagagattgggtggtctctgaaggcagtatatttaagctgaaatcttaataaaaggaggagctaccccattggggatgagtggggagaatttaatcctcttgacaatcctatcagtcctattccacagaggaggaaaatgaaactcagaggggctagatcacttctccatagcaggcctgcgatacacagactgctcccagtttacaaatgcctctctaaagaactcacactgagtgtgggctgccacaaggcgggagggaaatggagaagacaggtgatttgggacatgtaacctcagagtttattatttcaggtgcaaccagcctgagtgaaataaatttggagagggagagggagctgactttttggtgagcatccaaagagctggtcttgttggagaatagggaatgcccagcatccacatgagcaaggccaggccagtgtttgatcctggctctcttggggctgccacctttcatttccatcgctggaggtagatgctgaacatcacatttaaaatcaatctcctcaagagaagcaaactgtgaaaagctttttgggggtgccatgacctgcttactttggctcattagcttatcattgcaaaatatgaaaaaaaatttcattggactccaagtctcacatattctggacttgctggccaaccctgccttctttcgggggtgtctctgttttctgcaagcttctgatcagggatttatgatgacttagatgaccacttcagagcgggaacttgtgtttttaaaataatctttgtatcatccatgtctacttgaggattgggtatagaatggtttctcctcacattctgaatacgtggatgagtgaatccaggttccagcaggaatgagaggcacgtaccccttcagtctcctcatgcatgtctcatgactggccacaattcccaaggtgatgatttagttcctttcgagggtgactgcttcctattaagacacaaggaatggcctccatttgttgtctgtgtattaaaaataaatacataggcaggaagattatcctttatagaccacagttacacattcttacctaatcctcatttcttgatttggcgaatcatcgtactttgaggatctgggactcccgcattatggaatctaggcttcttcatctccttcttctggagtcaatctgctttcataaaagggagatcattcctgttttcataataggtaatacccaagtactgtaacctggtagtcctcaaaatggctctgtagcttatatatgtgcatgagtatgtctgtggggatgtgtgtgactatatgtgacagtgtgtgagtatatgtgacagtgtgtggttatgagcttgataaaaatgaagatatctggatgccatctcagtactacttaacctcagttcctagcagggattgggggacagatatctatattttaataagcactgcatgtaattcttaaacacattcaagtttgagaatctggtccaggagagtggttttcaacactggaaacatactagagtctcccagcgagatttaggaaatcttgatgcccagaccacacccggttgaatcaaatcagacgctctgggaggtggagctcaggcatccataattttcaaagctccttgagtgattctaatatgtagtcaagacggagaacttcctttcagcatagcttgacataaaaaaaaaattcaatatagggaagtcaggcctgaatcaaatctatgagagtaccttacttcaagttctcaagaacttcccttagagcattagtgatactctgttctttgatcagaaagataactttactgaacaggtaaaactcatatgcctgcagccagctttactgctatgctcaattgagaaacttgctaaaagccagacttctgggacctacttatagacatggattgattcatcaggggccgctggggggagggggggggacagtgggcagcgggggagcctaggaaatggtgtttttaacaagcaactaggtgattctgatgcaattaacccttggtctaagtctcagaaacagtaccttagactagcccttctcaatcaggggtgactatccccttcaggggacatttggcaatgtctggagacacttttgattgtcacagcgggagtctgtgtgtgtctgtgctacaggaatctggtgagtcaaggccagggatgctgttcaatgtcttacaacccaaaggacagccccccaaaaacaaataataattatcccgtccaaaatatcaagagtgccaaggttgagaaactctaatctctcttctcaatcaacttcctttctgctagcctcaaagaaaggcatcaccctctttagaacttccacagctctttctggtgtgaaaaatcacctgtgtctgattcatctccctgacagaagaaaaccctcctcaggccaggatccccgcttcattcatttctgagtgtggcctcatttctcctccagcacacagtcctccctccataaatattccagccatttcaaacaaaatgaaaatacccttcaggaccaatcacgagatggctttgtgattggtaaccatgcatacccagtgtctacaaggagaaggaaaacccatggccggggctcattttcagcctaaaagttgaatacaaatctaccagccttcatctaagaaaatggctctccatatatatttttttcaacattcatcaaaaattccagtggcttctggggctgcttggggtctctaaagggcaagtcagttgtgtgaacacgaggaccacccacggagctcagccatcacgcaaggaacctcgttggctgtgtctactacagtgtccggctaccagttggcaactattaagtggttcacttggtccctgagccaaccctgaattccagaaagtcaaatccagcaaataactttacacagatctgtgagggaaatgaacaagggaacagtgctccccatggctctaaaaataaccaggtaattacctctgaagatctcttaagaagatgcacttaactgcacagaatgaagcagcaaaggcctcattcgtttgttgataggagctgtctctatgtagtcagccaactttggagtgttggaaacccaatcaatatttgggtactatggagttactatgctactgggctgatcatagttaaaaacaagaaactgcccttagtgaggctgacctgaccacattttttactaaattgatcatgctagttttcctgactttgatttttgttctgattttaatgcttggcatgaatgttgtggtgaaaggtatccactaatttttactttatgtgttggagaaatgtatcaacaccatcaattctttaaatgctactttaaagatattccacctccagcaagactgttgaatgcagaaatggaatatatcacagattggtggtgaggttccaccaatttagcaatttttctcccatggttaatcacccacagaatacactggtctttctcttcttcgtgttttaatttgcagtcttggcaatatatgctaaaatgacttggagttatgaaaagtatgaaacagtgtttgtttcaaatagttggctaggtgcttcatcagccggaggcctaacacaggtgtgaatatttgtttataatccaaacacagcaaagtacagtcccattttgcactcccttttttccatataatgctttaaatattttcttcgtgatggccagtgactttgtttaactttaaaaaaggctgaatggaaagaaagggcctggtgactggaaactgtttgtacaagggcctgcagtgagtgatgctaagctgagctgggcgtggagccctgacattttgtcagctccctcaggaggcagatgtgatgtccacgactcacctgtcaagtgctgatagaaaaacaactctgtcctaggtagccgttaaggctacatacacgacctctaaccccaggaccccttctggagttttccactgggtgtcaaaatcctttcaaatacttccagctgggcatctccttgaagtataattgcagctcagcattttaacactgggtccttgcggagggaatttctctgtcttttattttcccctcccccacggtaaggaccagttctgacatctcactggtagcaagagagaaaggttgccctcattgtttaaaacagcctttgcctcccagttgaatccaagtgtcctcctgaaagtagagtatttttgaggccactcgaattcctgttctcatctcaaacttctgaagcccttcatgcatcctgcatgacaataaatttttccatgctctggggcccagggtcttccaagggcttgttttcatttctctttttgcaaaagaggcaacaacaaagaggaactcagatgccctgactccaagattcagtgtttaaaaaaataaaacaacaacaacaacaaaacctagtaattgaatttcaagacaatgtgcaagtcttttgatctccattttctcctaacatgatagaaacccccaaaattatttttttaaaaaagaaaaaaaaattgggggaaaaccaacatacgatgtagctcagagaaaagaattcatggctaaagcaatacatttctcacaaatggaaatgtgcctcttcaatcagcacagcaaaaactgtcagttgatttaggccattcagagtaataaataatgaatttcatggaggaaggcaaaatcatcttaaaattatatcagttgagctccaacaagctctaagagttcttggattgagcatttctcaagacgaaccaaaatggccttggactgtgtccacaaggtaacagatctatagcaatctcgttgaagccacattatttccactgttccttcaagagatggtttctttttttctctcatttctcagtcagactaaaggacctcagcgtttgctaagcacatggatgttcatggctcctctacagaaattttgatttaaatgagctaaaaatgaccaaaataaaaggaaaatcacaaactataatctttagaaagtattaacatcattttctccattttatgaatgaggaaattgagattcagagaggtaaagtggccttttctcccaggttatagagctagtaaatgacaaactctcaatgagcgcttgaatttccttctcttctcttctcttttctcttcctcctcttcccttctttctttctctccttctccttgtcctcctccttctctttctttttcttccttctttcttcttccatcctccctctttctccttcttcttcttcctcttcttcttttttagagttggagtctcgctattttgcccaggctggtcttgaactcctggactcaaggtatcctcccacctcagcctcccaaagtgttgggattacaagtgtgaaccaccgagcccagcctcctccatttctttaaagccctgggcttaaaagtggttcatacatttctgggaaaaataaactgacagatgattattggacccatgataggcagatagataaacagatggcaccattcatgataacatatccttaggatgggaatactaactgggctagtttaggtgctcaaattagcaaagtcattgtacaacctgatacctggatgtcatatttgcctgactcttctagaacaactgcatatgataaattgtgtcaagtgaggttagcccttctgccctccctgtgggatcctaggcttagttttcaggcatttcctcccattttcttttaagagagtgtgtgccatcagcctgagtcacttcagcttcctcagtcaccagaaagcccctagacagcccagcctagttcccattgcccggcccaggcaccagctgtgtccaatcaaagcaatggcctccgaccttgttattcacatgcttggatgtttagtctgatgacctggggaactggaagaaggaaaaaagtataaatctctggaagaaactagaaatgttctgggtcaaacaatatttttgtagatctgttgtttgtgaatactctttctgaaaccacttagcttattgtgaaatgcactgttgaaggatgcaaaggatggtgtactaccttgataggctctgcaccatcagaatcagcatcgcttgggagcttgttacgaatgcagtatcttaagtcccagacccactgaattagaatattaattttaatgttaggaatgcagtgtcttgggtcccagacctattgaattagaatatgaatttcaatgagatccctaggtgattcacatgtacatttaagtctgcaaagagcccaggggctgaagagatctacaacagttccctcttccactttgcctccctttgctgctgggatgcatgatcactggccagaaagtgagcccttccaaccacttccttttcttcttcacctctgccttactcatcctttctctttcattccttgtcctgcctgtccaccaccaacccccttctactgaagtctctagaattctctttgcttgacatgaaatatcactatacaatgcagtcttttccctagaaaacttaatagcaatccttttttcaagtagaggtcattcaacctttcttactttctataactcaggacaaaaagtaaaagacagatttttccctcactgatcatggatgcttccagatcacactcattctagaacttttcctttgaggatttcttaaatacagcacagaaaagcctgatacatttttcaatattaaaattaagaaaataggctcaacaaaagatagcaaaaataaaattttaaaaaaagtttaaaaatgcatttgccactcagaattagtgtctagaatatataatgaggttctatataccaattaaaaaataacaccaatttacagaaaatgggtaatagatacattgaagcaattcacagaccaagaaacatgaatacccacaaaaatatgaaaagattcttaaccacactagtaattagggaagtagatgccaaaaccttagtaaatatcatttcacaccctattaaaaagttggataatatcaagtggagatgacgatatggagtaatggaaacttagactcctggagagaatataaatgtttatgactacacgaaagagcaatttggcagtatctagtcatgctaaagaagccctcacactatgaccaagagtttcacagctaggtaagaccagagcagctctcacccagacgcacatgaagatacgtaaaaggtgttcactggagcagtgtttgaaatgagacacattagaactgacttcatgttctccaagaggaagaaggctaaattgcatattcacataataaaaaactatgcagcagtgaacgtgaactctccctctctatatatgtatgtagatataccgtacatatattttatatatattatatgtattatatattatatacttgatatatgtatacatactttgtgtatacttaatatatatttatacttacatacacttaatatatatgacatacttaatatatgtatactatacaatatataaatatacagtatgtataatttatattatataaatatatattataattaatgtatactatatatatttatatatgaaatatatacatataatgtataacatatgtatttttatatacatattataaatatgtatataattaagaaaataggctcaacaaaagatagcaaaaagaaaaattataaaaaagtttaaaaatgcatttgccacatatatatacatatacacatatgtatatacatatagaatatgtatatattgtatatacatattatagaatatgtatatatagctatgtatatattattataggatatgtacatattatacaatgaatacatattctataatatacacatattctatatattatacaatatatacatattctatatatgatacaatatatacatattctataatacggatacatattttataataatatatacatattctataatatggatacatattttatacattatatatactctatatattagggaaaataatgtgtatatatattcaggaaaataatgtgtatattttatacattatatgatacatatatactatataatgtataaaaatacatattacataatatgtatatactatataatatactatatactatactatatactatatatatactatactataatatactatatactatactatatactatgatataatataatatagtatatatattatatatactatattatattatagtataatatagtatatataatatactatagtatagtatatactatattgcagagctttgggagcccaaggcaggaggatcacttgaggccaggagtttcagaccagcttgggtaacatagcaagaccccatctctattaaaaaattttaaaaatagctgggtgtggggaagcatacctgtagtcccagctactcaggatgctaaggcaggaggatggcttgagcccaggagatggaggctgcagtgagttatggagcaccactccactccagcctgggcaacagagcaagacctggtctcaaaaaataataattttaaaaataaataactaaacaagagagaaaaaaagcaggctgggcacggtggctcatgcctataattccagcactttgggaggccaaggtgggtggatcacttgaggccagaagttcgagatcagcctggccaacatggtgaaatgccatctctaccaaaaatacaaaaattagatgggcatggtggcatgtgcctgtagtcccagctacttgagagtctgaggtatgagaatcacttgaatcacagaagctgtagtgagccaagattgcaccactgcactccagcctgggcaaaagagcgagactctatctcaaaaaaagaaaagaaaaaaaagaaaaacaaaaaacaaatcatagcttgtgcattactaagacaagtgcagttaaaggttgctggaatgtaagagacccaggatatactatatatactatagtatagtatatataatatactatatactatattatatatatactatattatacaatatattatatacaatatactatattatatacaaatattatatacaataatattatatacaaaatattatatacaatatactatattatacaatatatactataatacaatatatactaatatgtatatattgtatatataatatagtatatatatacttcatatatatacacatatatagtatatatactatatatactgtatatatagtatatatactatatatactgtatatatagtatatataatatagtatatatagtatataatatagtatatataatataatataaatataaatatattatatatactatagtatatataatatatacatgttatataagtaaatattttatatattatataatttactgttgaatgataaaagcatattgtaggccaggtgcagtggctcatgcctgtaattccagcactttgggaagccgaggcgggcagatcacctgaagttgggagttggagaccagcctgaccaacatggagaaatcctgtctctactaaatatacaaaattagctgggcacggtggcacatgcctgtaatcccagctactcaggaggctgaggcagaagaattgcttgaacccaggaggcacaggttgcagtgaagcgagatcacaccattgcactccagcctgggcaacaagaacggaattctgtctcaaaaaaaaaaaaaaaaaaaaaaagcatattgtggacaaatacatagtatatcatttacacaacatttaaagacatggaaaacaaagcttcattaaaggaaactttatatatagtaaaaaagtaaagcaatgcttggaaataataagcatcatattagaacagtggttatattggtgagagtagaaaggagaacaaatacgttaggatttacacaggtgactgcaatagtgttggtataaagctttcttaagctgagtgatagatacaaaggataataaatacctttttaaatacacttttgggtttctgaaatactgattaagttacaacaaataatctttactctttaagactctgtaactcagctctatcaccctctccccactgttgtcaccatgatatattgatgaattctcatccatacccagtatacagttctgtccatccttcctaccacgtcctgcatgacttcagcactcctactgctcagccagccaatgacttcacacttcctgggtctcttacattccagcaacctttaactgcacttgtcttagtaatgcacaagctatgatttgttttttgtttttcttttttttcttttctttttttgagatagagtctcgctcttttgcccaggctggagtgcagtggcgcaatcttggctcactacagcttctgtgattcaagtgattctcatacctcagactctcaagtagctgggactacaggcacatgccaccatgcccatctaatttttgtatttttggtagagatggcatttcaccatgttggccaggctgatctcgaacttctggcctcaagtgatccacccaccttggcctcccaaagtgctggaattataggcatgagccaccgtgcccagcctgctttttttctctcttgtttagttatttatttttaaaattataattttttgagaccaggtcttgctctgttgcccaggctggagtggagtggtgctccataactcactgcagcctccatctcctgggctcaagccatcctcctgccttagcatcctgagtagctgggactacaggcatgcatccccacaccgacctatttttacagtttttttaatagagatggggtcttgctatgttacccaagctggtctgaaactcctggcctcaagtgatcctcctgccttggactcccaaagctctgcaattacaggtgtgagccaccactcccagtcacaggttgcattttggatcttgtcacccagaacatctctacccaatacccctggcactctcttctgctttttccttgcacttgcccagctaatattccctttgatctcctgggggctctatttccttgactttcttcctccattcctcccctgagttattttcttctttcctagcaaactaggacctataaccaacaccttagagctctggttgcaactgtcttacccaactccaggtgtccactttctcaaatcctggcttgggatgctgaacaatgctaacagaaatcatgtgatcgccctgatcagcatcatttcaaatctgttttctccagagcagggtgactctaggtcctgatgccactcttttcactcacccctagttgaaatcattatctgccttaaatatcagctctggctcccctttgcctagaacggcgagctaactgtggcctgcagagctaatggctcagggaggtgccacaggagtgagcccgggaggagaacacctctttggcaagctctgcctccccatccttgcttcaatctgagttggtctgctttaatcatttaaaatattggtcttacaagtaagatttcacataataaaaaagggaggagtcctgctctgcaaaatctttgagtggctttctattacacttggtataacacataaacccattacttacatggagtttgtgggatgtagctctgtcctcctctccaacctcatctagcgctattcatccccggcatcccacactgcagatacaactctactctcacctctaggctcatgtgccttctaccggcacacagacctgttcctctgttctttgtatgcctgatgcttcgttctcaaatttctccttacgtgtcacctgccctggtcttcctcattattctctatcacactaccttattcatctccttaacaacacttcttgccatcttcattcaacttttttgtttctttcctcattcattgtctgtttgtcccctcactagactgtaaccgccgtgatgggaggcatcacgtttgtttcatttaacaattagtagcagagccaaggagtagcttcagcccctcttctaaggctcagagtaggaaaatggatttgaaatgatgctgatcaggaccttcaccccaaactgcctcaaataaataactaaaggagaaacagcatcctttggtgcacatccttgctgtacacataaggctttgtagaaggtgccatggctctctccgttccagtcagatgctgcccatggacctttgtacagagaaatcctggaggtgcgctgggatcagtgtatccctagtgtatcctattcacatacatagaagcacacaggaacatttttttgaatgaatcaatctttgaaagtttgaaaaatgccagctgaggaaataaagttcacctctcctaaatcacttcgaggaagaaaactaattggaaatcagttttctcacttctcctgataatccattacttacccattgtcctattccaggacaaaagacaacacactacacaaagaaaaaactctccttcccaacacatgtgctacattgaatctccagatatgatgaactgagacacttacagagttaagtgtgaaagggcgaactgatttcacaataaattggttaactatttaagtgtttcaagattctacttaagtgtactcagtccatcttgatgtaagtagcaaactttcaaaagtttggaatgcctgtcattgtggcaatatgcaagtgcactgcaggacacagaacagtagttaattacttcaaatatatgagacagattagatatgatcagtagttaagcaagccaaaatcctaaacagaaaaatctcagtggtatccatgtgtgtacacaggttgtcatggccacaccttggcttggcaagtgcatccaggaacattttctcctaggctgccttttcccttgcctgtcatgattgtccacaagccttataataaaacatggtgagatagcaaacgtgggttatgtgggtgtgtttgtccttctctgcaaacaagattcagtctttcagaagaaatacacaagcagaaaatggcttcagacaaaaaaaacagagtagtatctatgggtaatagaaggcactgtgaaggcggatgggtgcagggtgttcaggtgtgtgaatagggcatctgggtcagtacagggattggaactgaaatggaggtgacagtggaggttatacagtagggagagtgagtctgattatgatgacagctacaatttttttttaaaataactctgacaaaccaggtactgggccctttacttaggtttgcttttttaaccctttcagaaatactatgagataagggcttttattattctcattttatatgtgaagacactgaggctcaaagagatgaagtaatttgccgaaggtcacgcagttaattccacagtcaggattttatctaggattccgtacttccaaactttgtgcttataaacactgttccatcagtgtcctctgttccactgtgtatgttccataccgtttcactgtattctctattggcaggacagtctagagattaggagaaaggttaagcttagagctgtaattgtagggggaatttcttagaacataacaaagacaatgagagagtcaatctctggcatcttccccgaggtgtggtatacaggtgggacttggggagcactgagaatttgtattggagaaagtatgttctgttgttccttaatttgaggatacaataaaaaaagaagtaaatctgtggctgaggtgaagggcagaacagtaaaagatacaggaaaatagatgtaaaacaataaccactaaaatgtactggccagtttactgaatgcttagaattgctgatattggttttagattgaattgctttttcttcaggtaactccatgtagcagggtctagggtgagatgcctaagaggtgtatttatttaatgatagttaatgatattcctgagtagaagggaagagatcagttggttctccataagagaagtcaaaaaggttgcaacaaactatgtaattcctgcctcactatcagaagaatggaaactggtatggtttggctgtgtccccacccaaatctcatcttgaattgtagctcccacaattcccacgtgttatgggagggacctggtgggagataattgaatcacggggggcaggtctttcccgtgctgttctcatgatagtgaataagtctcatgagatctgatggtttcataaaggggagttcctctgcacatgctctcttgcctgccaccatgtaagacttgactttactcctcctttgccttccaccatgattgtgaggcctccccagccatgtggaactgtaagtccattaaacctctttcctttataaatcacccagtcttgggtatgtgtttattagtagcatgagaacatactaatacacacttgtctgattcattatgactattccatttctttctctagagctttgctactcaaaatgtggtccatggaacattagcaccatctgcgagctttaacccagactgattgaaatagagcttgcattttaacaggctccccaggcaattcctatatgcagtaacgtctgagaagtactgccctagactatgtattgtgccagctcggcaacttggtgaactcttgttcagccttcaaagcctagctcagatatcacctgttctttaaagcttcccctagcaatgtcttaaagagctaatccctccttcctttctgctgtttctcctcctactcatctctactctgctcgtgacactgtgttcttgaggagagggtacctgtgttactcctctttgtattctactgtgtcagctgtgtcacttcaaaaagacaggttctaaaaagcatccagttattcgatttagttattgttactcaatttaagtccttcttggacaatgatttttaaatttttctatgcacaaaaatgacctggtcatcttgttaaattggaggcctgtagacctcacccctgtgaattctgattctgcatgtttaattgggccccaggaatttacattttaactagcagctctaaggatttctggtgcagatgactgagggaaatctctggtttagaaacatttcctggtgtctgtaatatggagcttctttctggtctagtggattgccgctgtcctgcatattgtgctggtctttatgtcctctaggtatcaagaatgccttaatcgattagtataggagatacccaaatatgtatggactatatatcagtaaggatgcctttatacagaaatgaaaatatgctacattgcaggccctaacagtttcagttactcgctatggtagagactgttgtaaagatctctttccctaaggtggaggttgtagtgagccgataatcgcgccattgcacgccatcctgggcgacagagtgagactctgtctcaaaaaaggaaaaaaaaaatctctctccttaaatggactcagtggttcttaggacccattccagtatgtgggaaacacgtgaatattttccacatacacagctctgattgtgtgagtgctgctatgtgccaggcaacatacggtaggtgaatacgttgatgatttcatcgaattcacaccatgatgctggacacgatgcaagggacactgtcaccctttgaatgataagaaaatgaagtcaggggttcgtgcttctttcctgtttgccaaactgtctctctgtttcttcagctataccttttactcattatccatgtaaaattccacagggatcagcagagggtgtggttgtcaggcttccctaaagtttcttcactgcactccacttctaagcctcaatcataaccatttttttccagttgtagaacatatctgtactaggccatgtctggaaaacacaaagaagtgatttatttcctttcttaagagaatttttaaacagtttgattttttccttagcggtgctgtctctaaatccacacatatcttcatggctggagtaaaagatacatggatacatatttttgagttgttatagcaatggaatcaaatcacaaaagagtggagacaatcaatttttgcagttgattggaaagacaattagaaaattagattgtcaggggcatagctaatttagttaatgctgcagagttctctgagaataaagcaaagttgttttgtctcgggaggatttgttatttggagggttgggagaaaagaatggattaaataaattatggtacatccgtaaattgagacacaatggtgctgatttctttcaatgtctactatatgtagggcacaaagatgaatacagcaggcccagttcttgccctcatagaatttattgtctattgaatgaagtagaactatgtagatctatatatactatcatcgaaagccatccaagatacgctgtaaatagtgcataatgtaaaaacggtatatgtttgtgtacaaatgaatttgccagatggttacatccaatgttattaatggcagttatctctgaggactagtaatgggtttgggttggggatcggaggaatggaagggaatgatgaactgtgcaactttttgtggcagggactgtgaactacctgccctcgaatcccttcttcagtcaaaaaagaaaacaaaatcaaaccaaaacagaacaaaattaatacacaaataaaataaaccccaaatattttccagactccttatggctcggtgtagtcataagactaagttctaggcaagtagaagtgttgtatatgacagctagaaagggcttctagaaagggaagatatttgcccttttgcctatgttgctttctgctgcttgggatgtggattcctggtatgctcccagcagccatcttggaccatgaggagatctggagggcagaagccatggaggggagaacactaggatgaaggaccatgagtctccttcctaccaacctgctaccacttttgccgtctgctatgatagtagcagtagccacatatgaatattttaaattaattaaaataacataaaataaaaagtttaattcttcagccctactaagccacatttaaagtgctcagtggctacctgtgactagtggctactaaactggacaagacaaataatagaatatttccatcatcacagaaagtcctattagatagtgctgctctgctgcctggttcctggttccaggctttataagagccaataaatccccatatttacgtctttgttacttgtagttgaattaaacatacactataccaaatccattttataatgaccatatatcaattttatgatataaaactcatatagttttaaatacacaattaaacatcaaacatggattaaaacagatcaagatatattataaataacttggtttgattatttaaaaaacaggaatattgtgtcaaaaataaaatttttaaaaccctgggtatagaagagatctagaaaattataaacatttagatgtgtttccaaaagcaaaaggctgggcatctgaaatttatataagcttcacttggaatcgacatagaccgcacaccaagtaggtgtatacatttctatagagttgctgtctgcacattcagctatggagcatattaagaatgttctgagagatacactgaacattcacaggagacacttttataaggataagatatggtctggtgctctctagctatttatcaaactctctgctgtttgcatttgaaaatatacaatgacattacattttaaataccctaagttatattgtgctgcctttgaacctgcagcaaaattatgataccattgtgtatttttaaagattaaatatttctcatatttttgcactacagcaagcaaaccaaaggctttttagcattccaggtcatgcagactctttcaacaaggttgtttattcttcgttcaacgtgtgcgggattcaggagaatcatttccattcttttaggaaggtgccacccaggtaatttttggcacataaacgtcaatgcatattccatattctgatctgtttggaaaatgcagtacataaaacccattcaccaggctaaggtcactaagggcggataaaccaacgctctgcagtggctgcttataactaagtagaaaaaccttatgctttcaacagggcaccaaatttagtaagtccctaagcacccccacctggtactctctcagcacaaatggaggacatgagttggttttttttcccttcctcatgtttgtgtgtgtttatgtgtgtgtgtgtgtgtgtgtgtgtgtgtgagagagagagagagagagagagagaaacaaagagagagaatattttattcttccaagttgcgatgatttgacatgtgctgtttttacatatttccattttctagtttcactgaaagtctcaaaggcttatggagatgagaatcaaaagttgggaaagtgtgttcctggtaggcaaatggtgctgttatgaaaacctttctaaaaatcacattggaaaaaaagtggtttcaattgtggactttatatgaccaccgtgtcacttttgtatttgcctgagaaacaaagggaggagagcaaggagtgaagatggttgggagatacaattcggagagagggcctgtttctaatactcttaatactaacttggcatttcagagtgttgtttatccccttccagttccatcagcagtggtgatttttagtgccatcattagtaacttggtctactgtctcattcaatatagcgtgaagtccgacatccagaaaatattgaagaacaatttaaatttttactgaagtctcaagaaacaatgagcaaaggggattgcatttttaactcacagaaatgttataaagttctcttttccgccttttatcccattgtttctggagtgcagccaactcttgttgaatctccctgcaacctccacgctttccagactccctctcgcatggttctttcttgactcctgacccttgacattttggatccggtattttctttcatcagggtcttggtcttttctaatgtaaggatttcaagattttctgtatattttttgacattttggatctggtattttctttcatgagggtcttggtcttttctaatgtaaagatttcaagatttttctgtatattttttgacattttggaactggtattttctttcatgagggtcttggtcttttctaatgtaaagatttcaagatttttctggatattttttgacattttggatatgctattttctttcatgaggttcttggtcttttctaatgtaaagatgtcaagattttctggatatttttaaattatctttctgctattcccagcattaacacaaccaaaggccctagagggtgagcaggcaaacccagaagccactcagtaagcactgggaaaaggaaagcctgagaaacttgcatgctacatttttccttttgtgtgtttcggctacgtacaccttttaacatccttctagttcatcttcctttcttccagccttcaggcccccttaactttagctgctctgcaacattagctagtttttatccaatgactcctccccaccccaaagccagccacctgttccttccctcccctcttccctccctactgcctctgctatgtgaccttaagctagttgcctcagttccctcgcatgtagatcacacaccttttctagaaggtcccagtggggccctcctcttctgagattgtaagattcaggtcatgcttactcaagaacaaacacctgacttggttaaaagtgaacacctgagcatgggttgctccttctcctttaaagtattttttgatggcacaagtaacaggtatatgagtataaattcctatacaaaatgaaaaccattaagaatgagactgaaatcattccttcctctaaccccaaactacaccccctcaattttttgagagattaaagaaacacaaaaagccccaaatttcatccactttacttttttttttttttttttttttttttttttttttttttttttgagatggagtcttgctttgtcacccaggctggagtgcagtggtgccatctcagctcactgcaacctccgtctcccaggttcaagcaattctcctgcctcagcctcccatgtagcggggactatgggtgcacgccaccatgcccagctaagttttatatttttagttagagacagggtttcaccatgttggtcaggctggtctcaaactcctgacctcaagcgatccacctgcctcagcctcccaaagtgctgggattacaggtgtgagccaccgtgcctgatctcactttacttctttaggagtttgatctgtatttttgctgagagttttctgtttttatacacatatgtatatcccaaaactgtataattttgttttgtaaagaattgtttaaacatataaatgctattcctgtacattttttattttccagttcctcttgaatatctgagaggctggtaaaaatgagataagctgggtaagtgtgttcttggcaggcaattggtgctgttttgaataaaaataaaaatggtacactgtgcttattgttttcatttgctttcttttgcccttgaagtcattgttactatagaagaacatagatcatttttttaaaaacagctgcacagtattccatgtagtaggaagaagtagaataatcatacaggtagctaaaatttatagactgctgtttgccaagaactgttattatttaatcttcaaggaactccatgaaataagcagccaatactagtcccattttacaaacaagatatctcagaaccaatacaaaattaccatgccttatttcatctgttgccagacacgccagttgtttcaattgcttgcggtgacaaacatgagaccaaatctccttgccgaggtgcaggtaggatggtgccaagatgggaacagatgaggtgtggggcatctgcatttttagattcaagagatacttccagacttccctcatgatcatattaagagagactgtaaatattgagaagggtgggggtggaacatagaatggggagtgagctggtaggatggccagaaaggggatgggtggagggatgtatggcagatgcacctgacggcaataacttgcttaagcctaccctgaaaatgaccccatatggcacctgaatatgtgtctggagttccgagctaaggaatccaggagcggccaactgggagattttttccttgtctgtgaagcacatttgaagcccttggatccatcctgtggaatgtaagctgtacaggagatccgggccctttgttttgggttaattgaaggttgccaggtggaggttgttaggcagagggtgctaactgaaaatgctatataaactgcatgctttttgcaagcagttgtggttcttctgcccagtctgccgccactggaccgtccctgtgtgtaagtttcccactaataaaaccctgtgtctcatctgctggctccaagtctcttcggcctcttgaacatgataccatccttgttgaggttaacaggggtccagcacaacaagggacagctcaaactccaacttcatccactttctaattgtgcataaggaaaattctgggtaaaagcagccttttcccactatttcttcccacctccctaaactccaaggcatcgtctcacattctgctttgtctcccctgcccaagaccttccacccgccctgcggtgcatctgggccccagctgtgccaatgttgttaggcttaggaaagatttcaagactttcagtatttactttatcccaagaacataaggcaggcagacaggcctccatccctacgttccatttacacagatgtcaggccatggatgtaggttcatttttcattctttaatccacaggtaagaattaaaccataacctgcctcaccaacaccacagcatcaatattttctcagactggaacatggtttccccgttcttatccaccatttaaaaataaacttaacatatggcatttgtcttatgtcaacggaatgcaatgtgcttttcttgacatatgactcaattcaaacactgggaaaaactttgatatttcagaggagtgtgcagtgggagggaagaggattgctaccttcccccattaaaccggttaatcccttgaggcaattttccagaacctgagatgtcctgagtttcccagataattgagtttcttaaatcaaaatttgtgtcatacagacccaagggtaatgctggatacttagtaagacttcttaaaatcacagtcaaaccaataggtaaaatgcatggaagttgggagcaccaaagattatatttatgcagttttctcaaaggccctacaatgccagaccaatcattcaaacacaccccaatgacaccacatcaatgaaggtaaaggaaagaggacatggacacacagcaaaagcttgcaagtggggaaaacattcatatacaagcagagcaacagtgaaaataactaccacttgctggatgtttataagccaggcacaaacttagtgctttgcctatgtgatgatgttcaatactcacaaccatcttccgaggctggtatcattatgagacccattttacatatggggaaattgagatttaggaagcacaaaattttggacaacgttatacagctattgaaggaacaggaatccaagtccacttctgtctgattctagagcttggcctgactctgttcataaccttattattacatgtcattagggagagcaggttgtacatcctatctctcaaaacataactatgattctgtgaatttttgcctccaaacaacgtctcaacttttttttttgagatggagtctcactctgtcgcccacgctggagtgcagtggcgcaatcttggctcactgcaagctctgcctcccgggttcacgccattctcctgcctcagcctcctgagtagctgggactacaggtgcccgccaccatgcctggctaatttttttgtatttttattagagacggggtttcaccgtgttagccacgatggtctcgatctcccgaccttgtgatccgcccgccttggcctccttaagtgctgggattataggcgtgagccaccgcacctggccaacaacttctcaactttctaacctgcctgttcaggcactgaagtagcctcctagctgcgtacccgatattctaatcccttcacctatgttactggaagagtgatcttccaggggactagaatatcatcgtgagctcacttgctcagaaatcctcagtaattcttatatatagctctatggctaagacagtgccctacagacagtgagcacacgaacatttactgaatgactaaacatgctccagtgaccttcctttccctggcacagtttctgaaattaggtatcccaggtcacacctatagatcaggtgatgttaaatactggaaaaacactctcttccgagtctgaaagacttgagctctgtctttctgagctctgtgccctcaggcaaatcccttcatagctctggttctttttccttccgtgccccattacctggtcagtgtaaacttagcagtggtatatgcctaaggcacacaggattctcacaatatcatcattaataaatactgttgaaacattttttcagtcagtcacatcttaataaatcaacagatctgagccatttcccctgtgactgcgaggtgggagcaggatatttagggaagaaaagtttttgtgagccagaagaggaggacttcttggaacatggtgtcctgcctggtagaaggttggtggtgactagctactcccctggtggccctggtattttagaagttgctgtggggaggacaggagctcctgggagggaaaagaagaatccttaacaagaaccaaaaatgggccaaagacattttactgacctcagagttttgactacctgagacccagattgagctgtaggcctaggagaaagagaaacagtgaggaggacacagctgccttctccacctgtgtgagcaatttttgcctaaggcaatttgttcctggggactttgagagaattttttttagttaccaattgctgagaaacaaaccacccccaaacagcaatcatttattattgtctcctcatttgctggattggcaatctgggtggttcttctgctggtcttgcctggggtcactcacgtagctgcagtcatttgacagcttgactgacactggagagcccagtggcttcatttatgtgtctggtaattgatgcctcagctttccatgacacgccttctcttcctcccataggcaacactggacttcttgatagcagggacatatcagggttccaggagggtgacagcagaagctgcaaggtctcttaaggcccaggtttcaggagttgtacaacatcacttctgccacatcctattggtcaaaacaagtggcaagggcagcccaaattcaagagggtggaacaatggagctgcctgttgttgaaaggagtgatgatgctgtgttgcagagatgcctggacatggggtggcatgagttgttgtgggccattatggtaaaaatctgtgacaggggatatcctttcccacagtcagtatttccagaatgttctgcccttaccagcctaagaattttacctacagattatatagttatttggtttcctggggtcaccatgaatgactcttgttcaatgtgattggggttttggtgaccaaagccaatccagaaacctgcttctagagcctttctgggtctttgactctgcttctcccacctcccttttcctcctcactgaaaagcatggtgttgacctaaggcctaaacagtattaaataaaggaaaaattgttttgacactttaagatgttattcatcatcttcaggaaagggatccaattctagggactgttctgtaactgtactatcagctagcattccatgggcccagtcccagagcaatgtcacattcaaagataccaaaacataagtaattcccatctaaacttgcatttcttgaggagtattaaagaggatccaactcctaacctaaagcaccattttctctcagtttcagactccctcacacctcaagactgccccgccatctctgtctccctaatctccactctttgtttcctcttcagaacctctctgatgctcctaaatggtagggcctacacttctcttccctcgttcgttcccacatgagttttttcccctctataagtctctttcagctccctcagaagcaaatcccccagtctgagcccttcttccacagattggcttatggttttgtgaccttgctactagtgacattttgggccatataattctgttgtgggattgtcctgtgcattgtaggatgtgtagcagcatccctggcctttactcacaagatgccagtaacactgcctcccagtcatgacaccccaaaatgtctctggacattgccaaatgttctccaggtggcaaaagcacccccagttgagaactgctatcttagcctaacctgtatattaaaggctcttggaaaatgaggagggatgacaaaatgcatttctgtactgagagaggggcaataaaccaaaaatatatttattatacatttaataacttgtgtctctagtatagtaccatgatctagcagtgtcgtcaggagagaagaattatacatttaataactcgcgtctctagtatagtaccacgatctagcagtgccattaggagagaagaatgacccaaagatgagttaaattatgcattatgcactccagtctgacatgagcatgggatgctaacacgagcagccgcctggtgctatggaacgccagggcagttgggttcaggtctgagatctgccacttgttttcagattcagcagagctatgctgggggttgagtgtgagtcattgaaaagtctcttcacatgtttctaatgtgaacttctggttaagaaattcatcttggccgggcacgctggctcatgcctgtaatcccagcactttgggaggccgaggcgggtggatcacgaggtcaggagatcgagaccgtcctggctaacacggtgaaaccccatctctactaaaaatacaaaaaaaaattagttgggcgtggtggcgggcgcctgtagtcccagctaactgggaggctgaagcaggagaaccgcttgaacccgggaggtggagcttgcagtgagccgagatcatgccactgcactccagcctgggagacagagtgagattccatctcaaaaaaaagaaattcatcctaaaggctcaataaacggaaacagctgtggtggagagcctgctgggatgggagatgagagacctgaggtctctatgaggtggttcactagctgtgtgaccttgagaaaggcatttcaccctctgggacttatttttatcatttttcaaacaagggagttgaaccacatccatatttctcgccaagaccaccttggatgtttgtcaaaatgcctatctgtgccctgatcaaattggaatctatcagggtaggagcccaaagatctacatttttaaaatacattctaagtttttgctacaataaggccagcaaagatgtagaaattatttctaggcaccaaactctatgataagctttctttgttttcatacctgtcttgtattattatacccatttgacagatgaagaaactgaggctcacactgatcaaacaaattcctcaaggtcttgggcatagtaagtttgggaagccagttctaaccctgggctacagagccacagagccacagcgccacagcccctaaccatgactcacggtatagtctgcctcccttctgaatactgacttttgagtgtatctgaacttgaatggtttctaagcctcctgacactttgaacgttttgactaattaaaaatttttcaaactatttgcctttacctgtaagcagtgatggctttgtgaaaaggcagtgttttttggtggggtgggaataggaagattcactgaaataaatgtgagaagaacacagcttccaaagatgagccgctttcctcattaagcctatttttccaggttatcatggctaattcattgccatatttcattatagaaactaactgaaagtttataagtaagtacttttccgtcagaggttgcagttaatttcaacttcaataatcattaatgtttctgtttttatgctgactgattcggaaatcctaagaagtcacatggaagctggtttgcagtttttaatcctcttttcttctctcctagatagtctatttccgacagccatattggagagcctgggagaggcatttgttttgattttcttcattaatgtttgatctgttcaggataaatcacagagaatgcgtaccaggctgaacatttgcaaggaaaatccgcaaaataaagtcaaattcagaaataatttggttacaccaattcatcatgtctagcattactgacaatatttagacaatgtaattccgattacacctgcttttagggaaaaaaatcagttaccctaaattaaattaacatttttagtgtatataatttgtagttcagaatgagctataattatcatttaggagaaaccatgtggaatgcattaccagccttctaagtcttgggttttaaccatgatccatgactcaaaatgctttatccaaacaggttgtaaattctgagacaagcaagatgcatttcagtcatttctactttaattccaaatgaagaattcattgtcttttcaaattataataaattgaagagcaatttcccactaaacaaatcaaggaaattgaaaaattacttctctgggagctgttttctgcatccttttaaaaaaaaaaacaaaaccatggttttattattcttgatgtgtatactaatagacatctgcattgccaaaacaattttcttccccttctttaaagtagaaggtgaactctgaaaaatgttaaatgttcaatgtaatttcattccagggggagtctggagcctgcaatgagagctcacatttaagaacctcaattaatatttagaacattagctcccaaagcctttctctctcaatgatgcacttcctggggaaccacagaactatgagtcatgaagctaaggattcatgtaagccatacctgtgagcactcagatgtcctcaaaattgttgggattgttaaattaatctgagatttagatgcacataacaatctcgtagaaaagagaggaaatggtaatgcacgaaggaccaaaatggggagctgaaaccaaagccagggaatgactttttaaagtcaggtgtgctctgtcttttgaatatctatttctcccgcccttgtttttctcctttaggtagagacatggggaagagtctttgatgaacagagaacaggggtatatctgtatactgccatttcttattcaaccacaccagcaaaacactttgacttactctaaagagtgacttggtctctggttaggtgatctggaccccagattgtacgcgcaaggcttatttttgtggctattggcactgtggaaatttctgacttcatttcacaatgctgggctctggcaaatgagttaggagctttctgtcctgtgggttgcagcttctccgaagagactggttggcaggcactaagaccaaagcaccctcagtttgaagaagagtttgttcatctaggaggagcatgttgaattttaaagggcttttctgagggtaccacagagtttcttggaagggcaccctgttggcaggattttggttggggtggtcactggacattggaatattttaacttcatggttcccaagttgtgacaaatcaatggacagatgtaggacatcaaactatcagttgagtgactattgtctctcacggaattgtcctatttctggagcatgaaggcagtttaatttcacttcgtttttatactctaaagttggattaaaaagacagaaaaccaggaagagtagttttatgtgggaaatcagtaactgtcaccatgtgaaaaactttcctcattgtttcattattccaatcagtattcctaatttgtgtcaatacaaatacaaacacagatttcttagatttagtggtgaaagtcaacttatataccaaagaactaagtccaaaaccaagtcatagatggacttggagatcagctacagaataatgatggttccaaagctctgtttcagatgggaaccaaagagccaagcataaatatggcttgacagtagcagactcttcccagagggactctaggaagtgtggataaagatcatgagaaaggttattatagatctttactaaggatggaaaagaggacatcttttttttctaaaattttacttttctgggtgatattttaaccataaattcttttttcctaaagaaaaaaatatttctaagtccatagtaataaaaatctatatatttgggagtaaattgagggttaggcctgggaataaagatttttcttttgccaccgcctgacatccttccctctccccttccacgtactaaccagttaaacattgtagaaatatataaacactgggaaaatgctgactatttctcttttggtgattctcagagcagtgatccacaaggttgtgaagaaaactccagagattcatctcatttgttctttgtctatttataaagtgcttaggtcaaggcctgctgcatagcaagtgttagaaataaatttgttattattataataattattctgagaaataaataagatgatgtttgtaaatatttcagcagaatgcttgtcacataatacatgctccacaagtggtagtgaatatagacaaaaattaggttatataataaaacatctaattatatattgttgttattgtctttgcttgataaactcctagtcatcccctaaaatcccaacttgagttaaccttcaaaaagaagccttccctaccactcctaaatataattattctatcttctgtagcactttggcacttagatatcatatgtacacgttttattgtattatgatgagttgttcactgttacggcccttttgatgggtcacaaactctctgaaggcaaagatcatggtctcttcagcatcagacttcctacatcccatggtgcagtgtctggccatgtggtaggtgctcaatagacatttgttaaattgtgcaaaaacgctaggcttagagacaaagggaatgctcccatttttatgcccaaatgaagatgggaatgtagagaatgttattctttgaaaaaagaaatctcaggggcttacttgaaaacaggcttgagtgcttacaaaaatgagtgccaaaagcaatgtataagcaactcaggcctaatgcagccccaatgcgagaaaacatcccagcctctttctttgactcagcagctgcacaacagatgggaacgaccgtggctcagtcacgctgccatgggactagggaaaagggaccaggctgcaaaaggaagagaacattttctcccatttgttcatttgaaaatacaatgtcctttaaagttcaccagcactataccaacataacttgacgtgagttttggtgctcacggggaaaagggggtctaaaatgaaatccatgtaaccctcatggccctcatgaggatgagatgtgagccatcttgtctaaagatgtcctttcttcttccccaaggtcttgcatttttttcaacccacagagtgacgtgattgggacaaatgtagccagagtggcgggaaggatctgagcagagagctttggtccagaaaatgtctgtttatggggctgagtttgcaaaaagtgcaatactttggcccaaagccactgccacacaagcaaaattccaagcgtctgtgtatcctccaccaccccttcccaccccccgactgggagaatggtctccacctctcctgcctggctgcaagagaattctcccagttagctggcttacccacttcatcctgggccctatccctgttcccccaaacaaaaagcagcttttcttctttctctgataataaactcattgatgtatccatttaacatcaaccaggacgggtaccaggcatggcgtgaagtgaggtgacaaagttgcagaagtgattgtcctcaaagagctcccagttttgctggggacagggactgtagacatgcaattataacacaattttgataagtcctcaaagaaaaatatgttcaaataattatcaacaagggtaccagaaaggtagttatgtttaactttcctgggaaattggtaagatgagggtcttttgcctttcaagttagaaagataaggagctagcaccacctatggattctagaaaaggaacttggtatcagagtagaggccatttctttataaactgttcaaagagttctcaattatacgatagatcttggggaaatagcttgtttgcactgagctgtcccttataaaaaggggtgagtggtttgcagaattttaatgctttttgtctagaactatcacagtcttaattgcctccaggtattaaatccttgcacacatggttccaatccataaatttttttgccattatgataaacatgtgcctgagcctcccattcctggcatagctcagcagaaagcacttctaagcttgatattacatttccatgcattctgaacggccacttgttctaactctgtgaaggtacttcaggccctgtaaaagatctatatcccttgagaaacaagtggccagggcagagcagattcaaggcaattgataggaagaatgagttgttttgccctccaagcacaaaccctgctggcataacacacagggagggaggggaatagaagctggtccatgaacagaagagtttgaggacctagcttaacctctggggcaggtgccaactataataggtttgtggaaattgtagattcttgggcccacccaagacattccagatgcacacagctctgtgtctttcagagtctttagactgagtcttctaagacagatatatctgtggtcagtaagaatcattttttactgaaacatgctgatgtactgtgatgttgccatgtcttcattttgtttttctgtcttatcaaaaaaccctttctcttggctgggcatgatggctcacacctgtaaacccagcactttgggaggttgaggctggaagatcacttgaagtcaggagttcaagaccagcctggccaacatggtgaaaccctgtctctgttaaaaatacaaaaattagccaggcatggtggcacgcacctataatcacagctactggggaggctgaggcggaagaatcacttgaacccgggagatggcagttgcagtgatagatcatgccactgcactcaagcctgggtgacagggtgagacgctgcttcgggaaaaaaaaaagttttgtctttactggggatgtagagtggtaggcagaaaggggtaggatattggaaaagagagaatgaagtgggacaagaaagagaggcagagggaaagagggagggagggagacagagaggaagataaagtcatgagaggggacaaaaattccacactgccacaaatgtattacatgaggaaatttaccagcagcagatatatctcaggaggttttattcttttctttttttgagatggagtttcactcttgttgcccagactggagtgcagtggcacgatctcggctcactgcaacctccacctctcgggttcaagtgattctcccgcctcagcctcctaagtagctggcactacaggcacctgccaccacgcctggctaatttttgtatttttagtagagacggggtttcaccatgttggccaggctggtctcgaactcctgacctcaggtgatccatccactttactctttaaaagtaaaaactaaaagtgaagatgacaaaattctgacaactaaacattaatacaacttataggtaaaataaaatttcacagggttggcaaactttctctgtacaagaccaaatatccacagacaatatataaatgaatgagcatggatggatttggccgtcttggcagtagtttgcgaacccatgctaaaagataggttaacagctgcaatctcactagtgcaatgcatcttttgatccaaaggaggaaggtgtcttgggatacatttcccatcacttttctgctctttgtaggccacaattttgtgttaagtcagaaaatatcatgttttctctttgggatagaaactctggggcatgaatctttcacccaacttcccactagttccataaatttggatctcttttgtctttaaaaaagaggtaagtagtattccgtggtgtacgtataacacataagggacttagggacttgtggggaaggatgggaaggggagtgagggataaaagcctacacattgggtactgtgtacactcgggtgacaggtgcaccaaaaatctcagaaattaccacctaaagaactcatccatgtaaccaaaaaccacctgtttccccaaaacaattgaaattaacaaaagggagacagctttatgcctcaagaaaaaaaaaaaaaagaccagattttacaccacttcctagaagcccagagcaagacactgtggccatgttgatggttcttttccagaaacacagctaagaacttggggcacattagatataatgggttcagaagatggacggtctagtttctgtctctgcaagaataacttatactgtggcttttcatcaactaattaaaactgttaaccttcaaagtacattggttcatacatttctgttcatgtacatcttggagctcattgaaatcctgggtcaggcaccaagttacagaaccaagtttgcaaatgaataaaataaagggtgggaaagttaagagaatttccctttagggaattccagaaaaataatgtcccaagtatattccaaaccattcagcaccgtgtctttggtctttgcttttcccttagcagagatgttaaaatagaatgacttagatgtcagataggttaagttacaatcaccactttgcaaagataattcccaaagagctaaaatgtttctaagctccagccactggtctatttatttaaaaagatgttagataaagcaaaattcctgctcaaggaaagaacccaatgaggccctcagaggtcatttcaataggatttttgggccctgacaagtttaaagggtcccagtgtatctagagacatttcagagaaggatatgtgtgtgtgtgtatgtgtgtgtgtgtgtgtgtgtgtgtgtgtgtgtgtgcagtcacagcaatgactcactgggagaacagtgggacaacagcagcccaaaacctgacagttaccatagcaaggaaggggactttgacaaacggaaccctttcatgataatctcaacaatgtaatctgtaaatgtgtttgaaactccaccttaggggctggctgccaagtttaggggctggccagaggacgtgtgggtccagaactttgtagaacactcacttctatttttccatgacttttctctctaaagatgagctgagaaatttcttgtctaagctacattttgtaaaatcttacaaaaacttcagaaacagcaacaagtgttgagacataaacctatattattggaaaatgttggaatagtgtacaaattcttttaccagcccaaaaccctttgccccatcagctgttgaaatttcttttccctgtttttagagctctgttctttttcttccaaataaactttatgcacacagagaagcgcacagaatgtattttactcaataaaattttaactaagtgaaaacacaaattagctagcaccaagatataaatgtattactagtactctggaaattccccttgggctccttctctggcactatccactcttctgacaccataggttattttgtatgaggggtacttaacccagagtcatctcaccctgcccctgggcatttggcaatctctggagacagtgttggctgtcactactgtagagtgggtgctactagcctcttagtgaggccaggagtgccagtaaacatactgcgatgcacagacagccctttacaacaaagaattttctgatcccaaataccactaatgccaacctcaagaaaccctgctttacgtaaatgtagccatgcaatatgttttctttctttcttttctttcttttttttttttttgttgatatggagtctcactctgttgcccaggctggaatgcagtggcgagatctcagctcactgcaagctccgcctcctgggttcacgacattcttccgcctcagcctcccgagtagctgggactacaggcgcccaccaccacgcccggctaattttttgtatttttagtagagacggggtttcaccatgttagccaggatgttctcgatctcctgaccttgtgatccacccgcctcagcttcccaaagtgctgggacccatgcaatgtgttttattttgtgtttgtctccgtttgctcaccatgatatctgtgaaattcatccacattgttgtatgaatcagtacatttattctcattgctgcaaggtatttccccaataaaagctgggattttttttttttcagaattttacttgaagatatttatcaaatcatatttagtctttttcaaaatttcaaatcttaattctatgcttttgctttaggtttcccttaaaaattgaagtgctggtttgttatgacaaaaattaatacattatttgcttgctcatttggctgagtgactggttaacctattcctttgctttttcattcattcaatagccaataaccatccagtttcctgccaggatcttggaggtgctggaggattctggcattttctttgggtgcttacagaagtacactcagcttctagcatgcagcaggatggtcactcctgggagcagaatcaggctgggttggggggcagcaagttcatgaaaggggtgccacctttggttaccatctccacctgttgcctggatttgttttcacactgttttccccaaatttcatcatcgtctaacaaaccatcttaaaattattgaaaagacagcacttttggagtatgtgcttaattggaagcagctacctcccacaatacaactcctatgccctcccccatgcttctgagtccacacaaaggattttgcctgataggcaaagtccatttggtccttcagtcactaaatggctagaggggattccaagttagcctgtcctcactcaattttatgtcagtttctaagcaaattgcatcaccatgatgtcctagactagggtttttcaacattggcactgttgacattttgggccactgaattctctgttgttgggggctgttctgtgcagtgtaagatgctttgtggcattcctgccctctacctactaagtgctggtagtaccaccccctctccccagttgggacaaccaaaaatcttttacactgccaaatttcctctgcaaggggaggggttgtgtgtgcaaacatcatcttctgttgagaactactagtgtgtaggacatatttctttaccaggaaaacatttctagtataatatttaataaatagcccagcttaattaaatcactgggccttgaatgcaagcagagagagagtatctttggtattcattctatttaagacacaaagcagatttaagaactggaataaacatgccaatcaatgaaatgaccatgtgaaggtcagattcaaaacagctatggcctggcttcttggttctgttttcacacaggccttcagaatgtttaaaggtttgctttcaaagataaacctttcaattcatagcctctgttttggcttggacacaggttgagtctgggatggctggaagactgatatctgagggcatttcccttttgcttaacatttggtagataatgttttattatgcttgaatattccatcccaggatcatggttctcaaggttgaggttatgcagcctcataacattggaggacattctgctcttgagatagggaaggaaacggttaggatttgctgaacactgactatcttactggcactgagctaatcactttacatgcttatcttatttaatccttacaacaatctaataggggtaaatattataacttgcatcttgctaatgagagaactgaggttaaacaatttgtctaagacaaaatacttattatgtagtggagctggggtttgaacccaagggtggtggaacagagggctatagattctttgcctccctttgagagctgggacaggtttccccgaccttgaatcttggctggctctgtgactagttttgatcaagagaatgaggcaggtcttaagagatctacagtccccactttttcttctttagcaatgctccctcacactcgagggagcttaatgccatgtgagatgctggattatcctgaagcttctatattgggagtgataataggagttaagaagaaattacttaggcagatagtgagggtactggagtcctccgtaacaaagagcagcctgtgaaatcaagctgcagatgaagatgctggcagttatgccaatcatgttcaaaatggcagctccatcgtcccttctctctctgccagccacatgtacagcaaaaagcaaacaagatggccctggtcaaagcggaaagtccatttgcataataagatcagggtggggtggccagccttccccacgtgctatgtaaatgtcacatgtggtagaaccaatctgtgggccctacgtaaatcagacactgcctcctcaagcctgcctgtaaaatccagggcatccgtcgcaggccagccttttcctcttggaaacccctctctctcactagagagagagctgttttcctttctttttctttctctttctattgtctataagcccccactcctaaactcctcgtgtgtgtccatgtcctaaattttcttggcacaagatcatgagtcctgggtatttaccccagacaacgaagcctctttaggaggaagcctaagctagccatgtggagagagagaggccatgttgagcggcaggcatgtgccaggaatgtgaatgaagctttcatggacctccagcccaacctggtctctagctgaatgaggctggatgactctagttgattccatgtggggcaatagcatcatcccaccaagccctgcaccctttcctcacccatagaatcgtgaggaaaaaaaatggaggctgtttaaagccgctgagttctggggtggtttgttacagagcagtagaggagtaaaacactaggcctgcttgactccaacatacctggtaggttataggaagactagagggcaaaggtcagtaaaactgactttgttctattgccatctacctatgaggggaacaggccacactgtctttctccaggcactcaagttctatggtgaggttagattacattgtgttcacagctctaagagtctactgttctaaatgtgtgcacatctagatctacagactaccaagcattgtcagtgtgttgggtcaatttctctgttccaccaaactgtagttcggggagcctagcaaagcctgcacttttgacaactttctttaaagcttatctctctggtggatatcttcagaatccagagatcccactaataattgaacactgtggaatctctagacaattaaagcaatatttcccaaactaggaaaaatatgttatttaacacacttaaataattaatagttattatttatttttacaataccttctagttatagcaagtgatggtggcttttcatttatgtcactgatagaagttttaaggcaactttaagttaaaacagtgaattgacttaaaaaatagtaaataatagtagctgtggcatgaaaacatggctaaaatagtgaaggtaatagataaatgactgaagtttgggaaacactcgagacataggaagataaaatgccactgtagaccgtctttctgtttctccctttttggccgggttattcacacctagggctggcatattttgctgatcatgcaaaaggaaggctctggctgcgcaaatcaatactcgccatggcagaaatacatgcatcactacatttagctcaacaaaattcagaggaagaagaagtagcatacgaagaccaaagagagagacagagagagattatggaatattagaaattggcctgttgtggggtggggggaggggggagggatagcattaggagatatacctaatgttaaatgatgagttaatgggtgcagcacaccaacatggcacatgtatacatatgtaactaacctgcacgttgtgcacatgtaccctaaaacttaaagtataataaaaaaaaagattaataataaaaccacaaagcacacacacaaaaaaaagaagttcaacttggaaagcgatatgttttaatagtagtcttatgtttcacttggaaggcttgaataataatgaatatgacaggtcttggctacaggggtagagagagacatggagaagcattgagtcagaagtcaggtagcaatcaggctccgatgacatgcgggcatgaacaggctgctctctaggactggtttgtagacaccgttttgttaccactcttgggtaatctcagtgtggatactacagctgctaacctgcagttgcatggtgattcaggctctttaaatttatggtaatataagcatagaaatgaatctgcatatataggcatcgaactcttcacagtagttaccctaggggtgggaacaggtaggacgttcgcctcctaacgtttgacttctttagagtgagaatgcattgtgtgtctagagagaaaaattttaaaagataaatactaaagaaaaaattaggaagataaaaaatcaaaaaggttaagagttgagttctaagatcaggattcaatccaggattgaattccagctctgctacttactaactggctgactttgggccacttaattaacctgtctaacatttagttttcttgtctctgacatagggacagtaacagtccccacctgatacaggtgttgtaaggattgaatgaaacatttcacagtagtcattcagcacagtagtaaggtaggaaggagccaataaacagtgattgctattaaattagtaaattattatttaatacttagaattatacaaataatggctattaatcataatgatagtaagaattgatatgtttcagtaatgtttgactttttactataagtgtgcattacttttgtaagacagaaaatgctaatgatcagttttaaaaaatagtttatacagttagttatagttgacccttgaaccacatgggggttggggtcccagcccaccctgtagtcaaaaatccaagtacaacttttgactaccctaaaaacttaactagccttctgttgactggaagccttactgatatcagaaacaattaacatatattttgtatgttatatgtatcatatagtgtattcttacaataaataagctagccaaaagaaaatgctattaagaaaatcataaggaagagaaaatatatttactattcattaagtggaagtggatcatcaaaagtctttatcttccttgctttcatgttgaggaggaagtagaagagttcgtcttgctgtcttaggggtagcagaggtggaagaaaatccacacgtaaggggacccacgcagctcaaacctgttttcttcaaaggtcaactatattttcacaactgtgatggttaacctcatgtgtcaacttggctaggctatggtgcccagctgttcggtcaaacatccatctagatgttgccgtgaaggtatatgtcagatgtgataagaaattaaatcagtagatttaaatctacattgagtaaagcaaactaccatccataatgtaagtgggcctccaacaatcaattatttgaaggtcttaggagaaaagactgagattctccgagaaacaaggaattttgcttctagattgctttcaaacacaggactgccataacaactcttcctagaattttgagcctgtcccacagatttcagcattgccagttcccactgttacatgagctaattccttaaatttctctctcactctctttacacacacacacacacacacacacacacaccccatacaaccacatcctactggttctgtttctctggagatctctaatagaacaaccaattacaagtgctaaaaaaaatgctaagttcttcactgaatttgcccttcactccaagttagacaggatcaccaatattattccccttttttgggtgagaaacttgaggcctacaaaagccaagtgccttacccatagccaaaaaaaattgttcatagcacaattgaggtacgaacccttagggcagctgattctagttcctgtagaactggtaacgtggtaccacaatcaccttccagctcattaatatctagctccaggtaactctgggggcatcaatggccaagtgttatgaggtgggcttcctaaggaaggctcctgtacatcttctgagagcatcccactcatacgcaggtgtaacctatatatcctctctcctttctcttgaaacctggcctctggatgttcttcatctactctctatcgttattctggactctctaagaagtggatgggtggctggactctctaagaagtggatcacgcctgtaatcccagcactttgggaggccgaggcgggcatcatgaggtcaggagatcgagatcatcctggctaacatggtaaaaccccatctctactaaaaaaatacaaaaaaaattagctgggcgtggtggtgggtgcctgtagtcccagctactcgggaggctgaggcagaagaatggcgtgaacctgggaggtggagcttgcagtgagccgagattgcgccactgcactccagcctgggcgacagagcaagactccgtctcaaaaaaaaaaaaaaaaaaaaaaaagaagtggattggtgatgtgtttaggcctccagcaaaactggctacttaagagggaaaatgagaatacaggcaaattttgtgtttatacatgcacatacacacatacacataatttttctctcactttgtctgtaaggtaaaggagtagggaaaccatagtcttgtagcgtgaaaggttcttaatgcctacctactactgtgccatcttgcttaggaacacattattttcctctaggttactatagaacagtctatgttgtgcaaagaaatcacaaacaggcatgtgtcacaactcagtcataacacatccctctggttttctggagctgttagatctagctccatttccttcctctgtccttaccttacttcaaggtcaaacagtctgggttagagcgcttggtgacagagtaagaaagaaccgtgtttgaggtggacttgggttttagtctcaaattcagcatctactccaaggcatttgtcctccattatatttcagatctgaaggtcatttcacagtttctgaacatcgtcacacaaattcgtgtttgaaattcacaagatagtaaagttaaggtaaagattattttctccaatatgtattattgtcttcaatacgtattactctaagattatttctccaatatgctaagattcaaagagataaagtggtcttgacaaacagcacagctaggggagtggcagtcgatgtccgaggattctaaatccaaggctttcccttcgacaccacattgtgtctttcaatcaacaaatgctttttctaaaaaacatctaacatgtgcttgatacagcgatgaacaaagccgacagttcctgctctcctggagcttacattctaccggggtcactttctgaatgagttacatcagtggttctttttttttttttttttttttttttttttttgacagggtctggctctatcgcccaggctgtagtgcagtggcataatcttggttcactgcaacctctgcttactgggctcaagccatcctcttacttcagcctcctgagtagctgggactacaggcacacaccaccatgcccaactaatgttttggtatgttttgtagagatggggtctcactatgttgcccaggctggtctcaaactcgtgagctcaagcgatctgcctgccttggccttccaaagtgctgggatttcaggaataagccaccacactcagccagtggttcttaactaggggtgattctgcaccctagaagacacatggaatgtctggaggcatttttggttgtcacagtgggaggggaggtgctactggcatccaatgggtggagggcaagaatgccactgaaaatcttacaatccacaggacagtcccattcaacaaagaattatccaaccccaaatgtcaacagtgctgaggctgaggaattctgaagtgaatcaacgattctcttcaatctacgtataaagaatagaatctaaaattcagtttaaagtaagaaacaccaaatatacatgatgttggttctgtcatgtagaaactgtatggtgaattgaaataggaagttgaagagatttctccaaaggaaaagttttaaaaacactaattcaggcaatgtgaaagaagatttgtccagctacaagcgagactgataaattgctgtaataacaacaatacgctacttgtaaatactgttttcacgttattgtggcctctgaatttcccagtagtccagtcaaggaaaatgagaaccacatactcagataactaaagacctgctctttgcatgaaattaaaacatcaccattgcatattccgggaaccgacttttttttttctcactttgtggcccaggctggagtgcagtagtatgatctcggctcactgcaacctccacctcctggattcaagagattctcccacctcaacctccagagcagctgggattacaggtgtgaaccactgcacctgactaatttttttgtatttttagtagaggtagggtttccccattggggcctgattttttaacttaaatgtctaacttctgcaaaagcaaggaatccttgcaggtaaaaaaaaaaaaaaaaataatacaagtcttagtaagacagtgggatagctaattctagagttttcttttccaagccgagagagtaaagtggaagtgaggttactgtcctgagccttgcaactatgaccctcagggctatctggttacccgaggtggcactgtttaccagggcttggagcaacagctttctcaggccttgacagatagaaaatggcttgtccaattgagtcttcccttctttttggtagtaacgagccaggcttttccttaaacacaaatttttggacgctaatcaactctcatggaaagaatgaacaggaaattgaataataataagctaaccagtagctaggaataagttttaacattatatttgcacccataaacatgtgtgaccttagacaagttattttggccctcaatttcctcatatgtaaaatgagaagggtggattagatgtcttatgaaatcctatgaatcacaagttgagaaaataaatgatgctcgttgcgattaagaagtgttcacgatgattccattctcctcttcttgctccgtctctctcttctgcttgattttcaatacaaagttttgctttgttttgagacagggtctcactctgttgcccaggctggaatgcagcattgcgatctcggctcactgcaacctccacctcccaggttcaagcaattctcctgcctcagcctcctgagtggctgggattacaggtgcatgccatcatgcccagatgatttttgtatatttagtagagacaggggttcaccatgttgtccaggctggtcgtgaactcccgacctcaggtgatctgcccacctcggcctcccaaagtgctgggattacaagcatgagccactgcgcccggccaatataaagttttaaataaaataaacagaatgccattttttttctgaaaaaaagtgaactgataacactaggctgcatgagctcttatcttggagtcaagtgctaaaaatctaaatcagcaataaaaatacataaataaaaagctgggagtttacagagcaagggcagaggttgtgcccctgtctgattttactctgcttgtggtcaaggttgccttttgttacaagtgagcccaattacaatctctggagggccctgcgcaacccacttattgtgattaaaaggtcacttgaagccctgtctgagttgtttatcttaccaaaggtggtagaggttgcagttaaatgtacaggtattctcaggatctggaatctttattttctttgggtgtttgtgttttgggggctggtggctaggttgatcctgtcagtttaggagggtgtgtgtgtttggcacaggcctcaaatcaaaaccagcaactttggtttacagactttcaatctgcaaagtttttctgaagacactcagctttccaatttatcctaagttctagggggattccaataaatgactagcaaatccaagagcgatgctgtcactctctccggtgaagacgatgacagggccctccttggttgtctggcaacctgatgacttcccttggccctgaaactctcccaccaacttgaatgaaagaggtaactttcgggaaatccttggaccctgggtctgttgcaccccagctggcttccagagccttggttttcatacctcactgtggtctgggaaattcctcagaaaaatttgttaagacaatgtttttatcagtggatcgtatcagaaagtaggcaattttcatttcagggatgaacaagacaaatggagcgttccttacccacggcaggaataaaatatgcaacttattatccagtaataaggctcagattagaaaaattggttattattttatggcccttaatgaaccaggtcaagcaaactcgatgctcccaagtaaccctgaaaccaggtggttctagctctttaggctcccttcccaaaaatctgtacagcagcttcctggagctggctggaaggagttgagactgttggaatttggcctgggtctgtaagtctttagctaacaggggcctaattcaacacttcttcaaaaaatcaaaaagacaacgagtgtacttttaaatcaccctgaggtttgcaatctttttgatgtcttactctctctgcagaagaagacctccatttttcttatcatctgcagcacctctctaggtgagctatagaatgtgtcgtgccttaaaaaaaagtctcattgtctgagcctctcatacttgtctttcagcatgctgatttgctctggctacacttctggaaactggcagccttagggaggattttgtgaccagtattatgattttgttgtgagcttgccagtcctcttctgattccggttgagtcagtcttgttgagtcttgatgcttattctctctttgtttactccacaggagatttcatcacagtgcctccggcaatggactgcatacaattttctgtatagatgatgggactcgatcttaaaatgtattccaagtattgggcaatcccttttcaacctccttcccaaatagtactttttaaaaattattatactttaagttctgggatacatgggcagaacgtgcaggtttgttacataggtatacatgtgctatggtggtttgttgcacccttcaatcagtcatctagattaggtatttctcctaatgctatccctcccctagcctcccaccccctgacaggccccactgtgtgatgttcccctccctgtgtccacgtgttctcattgttcaactcccacttatgagtgagaacatgcagtgtttggttttctgttcctgtgttactttgctgagaatcatggtttccagcttcatctatgtccctacaaaggatatgaactcatccttttttatggctgcatagaattccatggtgtgtatgtgccacattttctttatccagtctatcattgatgggcatttgggttggttccaagtctttgctattgtgaatagtgctgcaataaacatacatgtgcatgtgtctttatagtagaatgatttataatcctctgggtataaacccagtaatgggattgctgggtcaaatggtatttctggttctagatccttcagaaattgccacactgtcttcaacaatggttcaactaatttacactcccaccaacagtgtaaaagcgttcctatttctctacatcctttccagcatctgttgtttcctgactttttaatgatcatcattctaactggcatgagatggtatctcattgtggttttgatttgcatttttctaatcaccagtgacgattagctttttttttcatgtttgttggctgcataaaggtattcttttcagaagtgtcagttcatatcctttgcccattttttgatggggttgttttttttcttgtaaatttgtttaattttcttgtcgattctggatattagccctttgtcagatggataaattgcaaaacttttctctcattcggtaggttgcctgttcactctgatgatagtttcttgtgctgtgcagaagctctttagtttaattagatcccatttgtcaattttggcttttgttgccattgcttttggtgttttagtcatgaagtctttgcccatgcctatgtcctgaatgatactgcctatgttttcttctagggtttttatggttttaggtcttacatttaagtctttaatccatcttgagttaatttttgtataaggtgtaaggaagggatccagcttcagttttctgcatatggctagccagttttcccagcaccatttattaaatagggaatcctttctctattgcttgttttcgtcaggtttgtcaaagattagatggttgtagatgtctggcgttatttctgaggcctctgttctgttccaatagtctacatatctgttttggtaccagtaccatgctgttttggttactgtagccttgtagtatagtttgaagtcaggtagcatgatgcctccagctttgttctttttgcttaggattattttggctatatgggctcttttttggttccatatgagatttaaagtaattttttctaattctgtgaagaaagtcaaaggtagcttgatggggatagagttgaatctataaattactttgggcagtatggccattttcatgatacatggatacctatccatgagcatggaatgtttttccatttgttggtgtcctctcatttccttgagcagtggtttgtagttctccttgaagaggtccttcatatcccttgtaagctgtattcctaggcatgttattttctttgcagcaattgtgaatgggagttcactcatgatttggctctctgtttgtctattattgatgtatagcaattcttgtgatttttgcacattgattttgtatcctgagacttggctgaatttgcttatcagcttaaggagtttttgggctgagatgatggggttttctaaatatacaatcatgtcatgtgcaaacagagacaatctgacttcctctcttcctatgtgaataccgtttatttactcctttcgcctgattgccctggccagaacttccaatactacgttgaataggagtggtgagagagggtatccttgtgttgtgtcagttttgaaagggaatgcttccagcttttgcccattcagtatgatattggctgtggatttgtcataaatagctcttattattttgagatatgttccatcaatatctagttttattcagagtttttagcacgaagcggtgctgaattttatcaaaggccttttatgcatctattgagataaccatgtggtttttgtcactggttctgtttatgtgatggattaagttcattcatttgtgtatgttgaaccagccttgcatcccagggatgaagctgacttgatcatggtggatacacgtcttgatgtgctgctggattcggtttgctagtattttattgaggatttctgcactgatgttcatcggggatattggtctaaaattctctttttttgttgtgtctctgccaggctttggtgtcaggatgatgctggcctcacaaaatgagttagggaggattccctctttttctattgattggaatagtttcagaaggaatggtaccagctcctccttgtacctctggtagaatttggctgtgaatccatctggtcctggactttttttggttggtaagctattaattattgcctcaatttcagagcctgttattggtctattcagagattcaacttcttcctggtttagtcttgggagggtgtatgtgttgaggaatttatccatttctacattttctagtttatttgtgtagaggtgtttatagtattctctgatggtagtttgtatttctgtgggatcggtggtgatctcccctttatcattttttattgtgtctatttgattcttctctcttttcttctttattagtcttgctagcagtctatcaattttgttgatcttttaaaaaaaccagctcctggattcattcattttttgaagggttttttgtgtctccatctccttcagttctgctctgatcttagttatttcttgccttctgctagcttttgaacgtgtttgctcttgcttctctagttcttttaattgtgatgttagggtgtcaattttacatctttcctgctttctcttgtgggcatttagtgctatatattttcctttacacactgccttaaatgtgtcccagagattctggtatgttgtgtctttgttctcattggtttcaaagaacatctttatttctgccttcattttgttatgtacccagtagtcattcaggagcaggttgttcagtttccatgtagttgagcagttttgagtgagtttcttaatcctgagttctagtttgattgcactgtggtctgagtgcaattataacagtttgttataatttctgtccttttacatttacttaggagtgctttacttccaactatatggtcaattttggaataggcatggtgtggtgctgaaaagagtatgtactctgttgatttggggtggagagttctgtagatgtctattaggtctgcttggtgcagagctgaattcaattcctggatatccttgttaattttctgtctcgatctgtctaatgttgacagcagggtgttaaagtctcccattattattgtgtgggagtctaagtctctttgtaggtctctaaggacttgctttatgaatctgggtgctcctgtattgggtgcatatatatttaggatagttggctcttcttgttgaattgatccctttaccattatgtaatggccttctttgtctcttttgatctctgttgatttaaagtctgttttatcagagactaggattgcaacccctgcctttttttgttctccatttgcttggtagatcttcctccatccctttattttgagcctatgtgtgtttctgcacatgagatgggtttcctgaatacagcacactgatgggtcttgactcttgatccagtttgccagtctgtgtcttttaattggagcatttagcccatttacatgtaaggttaatattgttatgtgtgaatttgatcctgtcattatgatgttagctggttattttgctcgttagttgatgcagttttttcctagcatcgatagtctttacaatttggcatgtttttgcagtggctggtaccagttgctcctttccatgtttagtgcttctttcaggagctcttttagggcaggcctggtggtgacaaaatttctcagcgtttgcttgtttgtaaaggattttatttctccttcacttataaagcttagtttggctggatatgaaattctgggttgaaaattcttttctttaagaatgttgaatattggcccccactctcttctggcttgtagattttctgccaagagatcagctgttagtctgatgggcttcccttttgggtaaccggacctttctctctggctgcccttaacattttttccttcatttcaactttggtgaatctgacaattatgtgtcttggagttgctcttctcgaggagtatctctgtggagttctctgtatttcctgaatttgaatgttggcctgccttgctaggttggggaagttctcctggataatatcctgcagagtgttttccaacttggttccattctccccatcactttcaggtacaccaatcagacatagatttggtcttttcacatagtcccatatttcttggaggctttgttcatttctttttattcttttttctctaaacttctcttctcacttcatttcattcatttgatcttcaatcactgatatcctttcttccagttgatcaaattggatactgaggcttgtgcatttgtcacgtagttcttgtgccttggttttcagctccatcaagtcctttaaggacttctctgcattgggtattctagctagccattcgtctaatcttttttcaaggtttttaacttctttgctatgggttcgaacttcctcctttagctgggagaagtttgatcatctgaaaccttcttctctcagctcgtcaaagtcattctccatccagctttgttccattgctggtgaggagctgtgttcctttggaggaggagaggcactctgatttttagaattttcagtttttctgttctgttttttccccgtctttgtggttttatctacctttggtctttgatgatggtgacgtacagatggggttttggtgtggatgtcctttctgttagttttccttctaagactcaggatcctcagctgtaggtctgttggagtttgctggaggtccactccagaccttgtttggctgggtatcagcagcagaggctgcagtacagcaaatattgctgaacagtgaatgttgctgcctgattgttcctctgtaagtttcgtctcagaggggtacccagctgtgtgaggtgtcagtctgcccctactgagggggtgcctcccagttaggctactcgggggtcagggacccacttgaggaggcagtctgtccgttctcagatctcaaactccgtgctgggagaaccactactctcttcaaagctgtcagatggggacatttgtctgcagaggtttctgctgccttttgctcagctatgccctgcccccagaggtggagtctacagaggcaggctggcctccttgagctgtggtgggctccacccagattgagcttccaggccactttgtttacctactcaagcctcggcaatggcgggtgcctgtcccccagcctcgctgccaccttgcagtttgatctcagactgctgtgctagcaatgagcgaggctctgtgggtgtgggaccctctaagccatgcacgggatataatctcctggtgtgccgtttgctaagaccattggaaaagtgcagtattggggtgggagggacccgattttccaggtgccttctgtcacagctttgcttggctaggaaagggaattccctgaccccttgtacttcccaggtgaggcaatgcctcaccctgcttcagctcatgcttggtgcgctgctcccactgtcctgcacccactgtccaacaagccccagcgagatgaacccggtacctcagttggaaatgcagaaatcaccagtcttctgcgttgctcatgctgggagctgtagactggagccgttcctatttggccatcttggaaccgcccccccgaaaattcttttatgaatgttgaatattggtccccacctcttcttgcttgtagggtttctgcagagagatccgctgttagtctgatgggcttccctttgtgggtaacccaacctttctggctgcccttaacatgttttttgtcatttcaaccttggtgaatctgaggattatgtgttttggggttgcttttatcgaggagtatctttgtggtgttctctgtatttcctgaatttgaatattgtcctgtcttgctaggttggggaaattctcctgaataatatcctgaagaatgttttcccacttggttctattctccctgtcactttcaggtacacaaatcaaatgtaggtttggtcttttcacatagtcccatatttcttggaggctttgtttgttccttttcatacttttttctctaatcatgtattcatgctttatttcattaagttgatcttcaatctctgataccctttcttccacttgatcagttctgctattggtacttgtgtatgcttcatggagttctcacgctgtgtttttcagctctatcaggtcatttatgttcttctctaaactggcaattcctctaaactttcttcaaggtttttatcttccttgcattgggttagaacatgctcctttagctcagaggagtttgttattaaccactttctgaaggctactttggtccgtttgtcaaacttcttctcagttttgttcccttcctggcgaggagttgtgatcctttggaggagaaaagccattccagtttttggaattttcagcctttttgcactggtttttccttatgttcatggatttatctgcctttggtctttgatgttggtaaccttcggatggggtttttgtgtggatgtcctttttgttgatgttgatgctattcctttccatttgttaattttccttctaacattcaggcccctctgctgaaggtctgctggagtttgctggaggtccactccagaccctgtttgcctgggtatcaccagcagaagctgcagaacagcaaagattggccaggcgcagtggctcacgtctgtaatccaagcactttgggaggccaaggtaggaggatcaccaggtcaggagatgaagaccatcctggctaacacagtgaaaccccatctctactaaaaatacaaaaaaaaaaaaaaattagccaggtatggtggtgggtgcctgtagtcccagctactcgggaggctgaggcaggagaatggcgtgaacccaggaggtggagcttgcagtgagctgagatcgcgtcactgcactccagcctgggcgactgagtaagactctgtctcaaaaaaaaaaaaaaaaaaagaacagcaaagattgctgcctgttccttcctcgggaagcttagctttgtcccagagtggcacctgccagatgccagtcagagctcttctgtgtgaggtgtccgttgacccctgctgggcggtgtctccaagttaggaagcatgggggtcagggacccacttcagggggcagtctgtccccagcagagcttgagtgctatgctgggagatctgttgctttcttcagagctggcaggcaggaacatttaagtctgctgaagctgtgcccagagctgcctcttcctgtaggtgctctgtgccagggagatgggaattttatctgtaagcccctgactggagctgctgcctttctctcagggatgccctgcccagagaggagaaatctagagaggcagtctggctacagcagctttgccaagctgcggtgggctctgcccagttcgaacttcccaatggctttgtttacactgtgaggggaaaaccacctactcaagcctcagtaatggcagacgcccctgcccccaccaaggtcgagcatcccaggttgacttcaaactgctatgctggcagcgagaatttcaagccagtggatcttagcttgctgggctccgtgggggtgggttccgctgagctagaccacttggctccctggcttccgactcctttccaagggagtgaacagttttgttttgctggcattccaggcgccactggggtatgaaaacaaactcctgcagctagcttggtgtctacccaaatggccacccagttttgtgcttgaaatccagggcactggtggtgtaggcactgagggaatctcctggtctgtgggttgcgaagattgtgaggaaagcatagtatctgggctggaatgcaccattccttacaacgcagtccctcacggcttcccttggctaggagagggagttccccgaccccttgcactttccagctgaggcgatgccccaccctgcttcagctcgccctccgtgggctgcaccgactgtctaaccagtcccagtgagatgagctgggcacctcagttggaaatgcagaaatcacctgccttctgtgttgatctccctgggagctacagaccagagctgttcctattcagccatcttgccagtccagtaatccaaaatagtacttacattctctctctttttttttttttaacctgctttcgatgtcaggttttgcctcccctgcatataaaagaagtttgtgctggattttctggccctgaattaagagtgacgtggttggaggggtagagagtgcctttcttgggaagtttgtttcccatcctttgggtgagttgattccatcatgaagacggtagtcttgtgaccaatatgagaaggaaccattccaatttaacagctggactcaaacagtacggatgtggtgacgtgagtgccattggctagcccttgggttagattctccaatctaggtctccatgagagctggaatcttttaccacttgagggtctccagtataataaagaataactcttccagccagcagatcagatctccagagacaggggttttcctatactcaaaggaagagaacagggaggcctcttaccattaatcaacatcaagtgtattctgggaagtcccagttagtgtttcggggcctacaaatcccagttctgggctaattccaaaccccaagggatcttggagcaaggttgcttcagtccatttgaaatattttccaagaacatgaagaacgtcttcaggtgagtctagtccccctttcttgagctgcagttgtgaagattgatatcttggacttggctcatgctcccatttttcttttctgctgttattattcttctaggagagattcaagttctcttttctggttttggaaacaatgatgagttcaggctatctctgcattttagtttaaaaatacagtatctgagaatgaatttacagggtaaaaattcctagcatgtgtcaacaaaggggagatgcactgttatttctcggttctaaattctgtgactctgtgatggtttcctactccactcagggtaaaagctaaagtccttacagggagttcaagctcaatactcctgaccttgtgcattctgacctcatcgatggattcccgcccctgtacccccgcttatccttgctgtttcttgaccataccagggatgtgcttgcctcagagcctttgctttagcagttccctctgcccccagatatccacatggcccactccttcatctctaacagctcacttttcaatgaggccttccctgactctgtttaacactgccacctgcctttccagtcctcccagcactcctgactgccctactgtggtgtgcttacttttttccaaagcacttagaaatataatgtaacttaattatttttatgttgttgtttttctccattatgccagaatgtaaactccatagaagaagcaatttttgtctgctgtgttcactgataaatcccacatgcctagaacagtgtcattgtgcagggtacacagaagggtctcaacaaatatatggtaggtcttcccttaacatcactgataataggttcttaggaaatgacttgatataattttatcataggccaattgataaacaagaattaagtttctacagcttatttctggtcgcaaaaacatcaccagatttataaataaagaccaagacacctctgatattaaacattgaaataaatgtgagttatacatacatttaggaaagattcataaaaacaagtaagataatgatttacccacttattccaattgagggtcttgggtggccagagcccatcctgacagctcagagcaaatgacaggaacccactctggacaggctgccttcccatcatggggcacactcacacacccatagtcacacacccacattcactcacactgggactatgtagatataccacttaagctaacatgcacaggtttgggaggaaactggagggctcggataaaacccacacagaccccacacagtggccctggctgggatgtgatattttctcattgacatcctagctaaatgacattgaacggaatgacattcgaggatttggtgtgtgcatatatgtatgtgtatgtaaatacacagatatgtgtgtatatttacatacatgtaagtgtatatttacatatgtacaaatatatgtgaatatattcacataaatattcacataaatatatgtgactatgtatatatatatgtgcatatagatttatgtgtataaatataaatatatttaaaataattcagtttcttcaagctaggtcttttaccttaaagaaacctcttcagtggtaggaaaattcagaaccctggagattttaagggcagagttgtgtggttcagattggggctagcctggctaaaaaagagaaagaaaaagaaaagccttctgcatttgttaagaggataatgtgtcaagaacacatagtaaatactgttcttaataatggaattggcattaggggcacccactgaagacccagtccattttagggatagtgtggattatggtagttcatcttgggagcgtgtattgggatataagcaacagaaaactcaactcacactagtctttagaaataaaaagatttaaccactggcccatttaatctgtaggtatttacccaagagcaataaaaacacatgtccacaaaagacttgtacaagaatcttcatagcagttttcttcataaaaggcaaaaactggaaacatcccaggtatctatcagtagaagaacagctgaactgtagtctcctcataaatggaatacttctcagcaacaaagaggaataagttacatgtaacagaatgaatgtatctaaaaactactatgctaagagaaaccttacacaaaaaatacatactatgtgattccacacatatgaaattttagaacagacaaaactatggaaaaatatcagaaaagtagttgcctctggaggtttgggatgggggatgatcaagaggaaacgttccaaggtgatggtaatgttctgtatctttgtaggggtttgggttacatagatgtacacatttgtcaaaacgtagcaacttgtaggccaggtgtagtggctcatgcctgtaatctaagcactttgggaagccacggtgggaggactgcttgagcccaggagttcaagaccagtttgggcactagaccctgtctctacaaaaaaaagtttaaaaaattagccaagcatgggccgggcatggtggctcacacctttaatcccagcactttgggagcccgaggcaggcagagcacgaggtcaggagatcgagaccatcttggctaacacagtgaaaccccgtctctactaaaaatacaaaaaattagccaggcgtggtggtgggcacctgtagtcccagctactcgggaggctgaggtaggagaatggcgtgaacctgggaggcagaactggcagtgagccgagattgcgccactgcattccagcctgggcgacagagcaagactccgtctcaaaaaaaaaagaaaaaaaaaattagccaaccatgatggtgcacacctgtaatctcagctactcaggaggctgaggcaggaggatcacttgagcctgggaggctaatgatgcagtgagctgtgatcacgccactgcactccagcctgggcaacagagacactgactcaaaaacaaaaacaagaacattagcaaattgcaactaagttttgtgcatttcgtggcatataaattttacttcaaaagataaaattataaataaatattgatctccactgaatcatatggatgctaaagtatttagttagtgatgtggatgctgtagtattcctgtcagacacaccgtctgaagcacaatagcatatagcataataattttcagatgcatccacgctgttacatggagctcattcctttttattgctgagaagggttccattttatatatggtaaactgtatgcaatttactttgaaatgtatcaaaaataagttggattgatggattgagagaaggatggacatgtggacagatatatgatcatgaaagtatggcaaaatataaaagatagcctctaagtattcactgaaaacgtctttagactgctgtacgttgaaacgattcataatataatactgaaaaaaagataaagtaaaattacttgctcttgtaaccaagaagctgagaggataaccaggctgctggcaggaatgaaaaccacacccttttcacagagctataggtgcccccagcaagccccaatttctcccaacaatattaacaagctcaccactgcgacagcctgaagaaccatcaggactaattgcatcctatcccgtatctcagtttctgtcagacacaccatatgaagctgactaactgcagaaaagctctcaccatgcgggtcctgcccacccctcccctacacgtaaactcttctgcgcccctggaactcatgctgcattctcagcaaagcccccgcatcttccacctcttccctgaatgtcctttcaccttcttgctccaactgaaaactgactctcccttaaggatgccacttcctgggcaaccctctcgaatgtggcttgttttttcacagctgctggacctggagggcacagatatcctccttgcttgttgcctcttcctggtcattcttctctccccaagctttgcagctcatgccatcacaccagaccattttcccccaagaggagtagcctagataactagttaataccttcctctcttgctaacatgcatcccatgcttgtcactgttggctgaagactgtgagtccagtttgactgagaaaatatctactcacctatctttttgctctgtgctattacttttgtgctgttactatggataaaccattcccgttcttttctaggatggatttttccactttgtactgaatcccacgtactctcatcattcacaaacattgctcaagaaattgctccctgtctattgctccccctccccacacttggctctctctatccccctttgtgttattttcctatattacatttaccaacgccttgtacattatttatttactaccagcttttccacaaggggcatttacctggagttaacctgggatttcaggaggtctttggctaggaaaataatcgtatcattattttgactatcttctaactgaaattgagcatttcctttaattatgagaagagatggaaaaccccatgacttagcagtgtctgtgacttgttatcaacaagaagttacagatgtgtttcctgataggaattgtcacattacagttgttgacaataccttgaaatataatttgtgctgattgctttgaaattgtggtagtcattaggcacatgcaggtagatggcgtgtgactgcagctttcctttttagagatcctcacgaggtgcagctggcagattagagagcggctctatgcctggttgtcattcagtcaccaaatcgtgttggtgacccagacacctcattgctttttaatatttcctacttacaatgtttatcaatacattgaaggaatgagttgtttctattgtttgtttaaactgaagtaagactgggcattcaaatgagaattcttaattctctataagggcacatggcattttacaacaaggataggtgtgcaggctaagaataaaaaccagacacattcaaatacatttgatggttgaaataattactgaagtatgctctttaaaataacattgctaacacactgcacagtaacaccggtcaagcacagtgtggcaagttactgaatttgaatataatttgttttctgtgaattctacatattttattttacacatgtgaaaatattgttttaagaaaggatctatagactttatgaaactgccatgggagtccatggcgcaagaagaggttaaaatcccgtactaaaacgcaagctccaagactttttctcttatgttctttgcaattgctcatctcttctgctcaagagtctaccacgtggtgggatttgattaatttcaagaataacctaaggccagataggacttggttatttacatcctctcctcaccctggcattcagctcctcactttccctgagggccacctttcctttattcaccataggtggcatattcattaaaggaattgcatcccttcgaatgactgaagataacattccggaaaatcctgccaacaggtaagggcttttctagacacaatgccaaaccttcaatacgtccctgttaggaggaaacagcattaaaaagcaaaaaccccaaactgaaacattctaacaagaaacaaacctgacaataacaactcatgctttggagacttccatgttgtttttataccccccctcccccaatgaaagaaacatcacattgcattctgaattgacattttcgccgtttaaagaacactgagacaaactaccttctcagaacagatctcaagacttccaaaatgacgaatttttctctactgaaaagtccacccttctggcaccagaggaaggctggaaaacctctggcaccagaggaaggctcttagggcgccccttgctctactagttggattttaaaaaatgtgactacttcctctattgagagaaaaagtcatagaaaaaaacatagttttatacagtgtggttcatttcaagaattgcaaccaaaataaatgaattaacatgctgcagcaagtcttaagtggtgaccacaccactactccagctatgtgtaggctttctaatgtacatgtcatcttcccaacctctagaaaaggcacaataagcacttccaaacagaccaaaaggacccagtaatggcagtactctttttctttctttttgagtcacagtttcactctatcgtccagactggagtgcagtggtatgatcttggctcactgctgcaacctctgcctcccgggttcaagcgattctcctgcctcagcctcctgagtagcttacaggtgcttgccaccacgcctggctaatttttgtatttttagtagagacagggttttaccatgttggccaggctggtctcaaactcctgacttcaagtgatctgcctgcctcggcctcccaaagtgctgggattacaggcgtgagccactatgcccagctggcagtacctagttccttatgatgggaaaaaatgatgggaaaggggcttttctaaagaaaatcacattaaacctgataaatatctgattaatagtgtcctgatatctgattaataaattccctagggtctattttttaaaatacctatattttcttataaacatttcaagaaaagagaactaacatctactgattttgtattacttccaggtggagggcttgttgcctgacaaatatcccatttgaattttcccaacaacccaatgaagggttgcaatattagggagggtcaagcttagaggggttaggtgatctccccaaagtcacatcctttccatcataatatgcagctcgtgagctcatggaatttccccaattttagcatttcataccatctttatgattctattatttgctcaatattattctttaaattggctgacttaaaagatgaaataaatttattcaaaaagcaaactttgcattgttgctagtaatgaagaaataataccacttgccatggattgaaggtaattggaaatgtaaatacaatgaaaagaggaacatgtcagcacattttggccaaatgtggttgtcagtaaatatctggggcccaaggctgactctctgcttaaactggaagcttgcaaggattggaggtataataaagccataattagtaccaaaaagagaggttgtctttggatagtcagaaggattgagagagaagtgaaaagaaaagaactccccaaccatgtaattcaatgttatttaattccatgacccagaaccacctaaaatcatctcctgaaccactggtggtacttgtctcatgcttgggaaaacatgatacaacgtactgtattgtagatagctttgacagatgttgttggcagattcctttggcctatgcaggatgtcatctgaagtttttgtaccattcccttgcatgcagctggcttctgaactcttgaggtctttctgtggcccataagagcctgcgtggctaacatgacggagggccaggcctgaagtggagagttaaatccccaagaacagccatcacatcatgagttggtggataaataccctgcttccttatgctttgttgggccgattgtaaggattgttctatgtagtctctcaaagagtcttctgcaaaaatgagaccccgatgcccacagcagcaacctgctcattcacattttctatattacctttcctcatttcctagtctcattctctgacttcttcattgtcttgcctgggatttcctccccagatgaattgctttcacctgaaccctttcctaagggtttgcttttagagaatacaaccaaagagcatatcttccggttttgtatctaaaaatgaaaaaaacaaagaaagaaataacataaaacaaagctatctacttgctattgtttccagataatcacatccaatcctgtactactcttattcttaaaatggtaaggtgaatccagatgtagaagcagccagggagaaggactaacctcttagaaactttccaataatgaagactttgtagactcttagtgcaagcccccatagtcatctttgatgattcaacctttcttctcattccggaaaatcaaaaattgatgtttaatatggcctagtagccacagtggatatgctgagatcttcttttcattctggtctttagacaatttggggggtagtttgattacatcttatctttcttatgtagattgaactggttgttgagtggattttctgatgataaatttcaaagaaactcctctgccaggaaagggagaataaccgattgttcattttacctaaaatgggagagctttcgtgacaatgtgtagacttgacttcagagtaaaatatgaacagaatttcatacatacctttagaatattgtctgcagaagttatataacaagtgtattactagatccacaaataagaccacaagccatatgagctcacggaagcttatgactcccattaagctttttaaaaaagtatgtcagcagaaaagcataatgatatatggactgctcacttacccacagcaaaacttgatgaaatcgtaacattttgacatagcaccccttttccttttaaagaaacaaaacatcacaaatatgcttgaaactctcttttacttccttcattcctattccctttctttcccagatggacttcgtttttctcctggattttatttttgtcattcttaaggatgttttaatacttttactacacagatggtatcacagactatagtattgctttgaatgtctttaaactttatagaagtggattattctgtttacatcagtctgcaacttgatttttgactcgatattatagagacttacccatgtttatatgtagaatttagctcccttattttaactgctataaaacattccattgtatgaacaaaccaaaatttatttttccattctccagccgatgaacatttagattgtttccagtgttttcttataataaaaaatgcctctacaaaatattcttgaacatgatgctttgtgcatatatgcagaaatttcttgtaaggtacatgcttagaagtagaaatgctaggtatataccgtgtgctgcttcaactttattagagactgcccagttgctctgtaaagaactatttataatccatcaacatatttgaaatttctctttctcccacattcttgcctacatttggtgtggacagactaaaattttttgccaacctgagggctctgaatagtattttatctttgtttcaatttgcattttcctaattcctagtgatgaaaagggattatttatatatcttggatgataattatttgtgggtttcatatacattgcaaatatttcctcctagtcagtgagcttctttgcatcttatttttggtgtccttggaggagtggaagttctgaattttagtgtagtcaatttaatcaacctatttatagttagtgcattttgtgtattatttaggaaatccttccatatcccgaaggcattcatacatccttctacataatatcctgaaaattttatagttttacctacagttaggtctaaaatccacctggaattagaatggagaacttgtatttaatttttttccttacggatacccaaatgtcccaacactgtttattgaaaagattgtcattccccactgctccgtatggccacatttatcataaatcaagtgtgcatatgtccaaggggatatctccagattctcaagtctgttttgttggtctatctatctgtgtcttaattacacaatgtttttattactttagctctataatcttattatttgccagtgcaaatacctccttccctgccttgactttacatagcggtttcctcatccacatgaactttaggataagcttggtttgttctatgaaaagtccctattaaaacggtacttaaaatttttgaatttataaattaatttggggataatatacattttgatgacattgaggcatcctatccataaatatttcttcatttatttcagtattcttttaagcatttcaacaacagtttatcattgcttttatatgggtgtcatgtttctcaagttctgtccaaagggaggagaaatagaccccacctcttgatggcaagtggcaggcttctggaaaattatgtggctccggaaatacttttgttgctattcttggaaaatacactttgctattgtctatcctctggccacaataatttatgtccttgtcatatgcaaaagaaaacccccaccttcttccctagaatctgcaaagctcaggctcacagtctaagatcttgccattaagatcacgttcacgtgcaactgaagctccttaagcttggctcctcaaagagagcgtctggagatagttcctgcttatcttaagatttgtcacctcaagaaacaatttgcagccaggcgtggtggctcatgcctgtgatcccagcattttgggaggctgaggtgggtggatcacctgaggtcaggagttcgacctcaggagttggtcaggagtctggccaacgtggtgaaaccctgtctctactaaaaataaaaaataaaaaaattagctgggcgtgatggcgggcacctgtaatcccagctacttgggagcctgaggcaggagaatcacttgcacctgggaggcggaggttgcagtgagccgagatctcgccactgcactccagcctgggggacaagagtgaaactctacctcaaaaaaagaaacaatttgctttctccctagagatgcaacatgtaatggtgaaacaggcatagggtaactaccacccagcctcctcttcaaaaacaggaggcactcaggaatctgtaaccattttgaaatccagcagggttcccgttgccagttccttggtgagggtgcagtcctactgcctggatataattcactgtggctctgcgttatgccctccatatcctctttccttttcaataaaaagtggcccattttgcagttgaatagttttctcagtcagcttcctgcatgtaaaatgttgattaaatcatctttccatgtaagctgatataattcttttaaaaaccctgtgggtttcttatgaattgatttctgatacactccatcagacaaaagctacatccacaaatctcgccaagattttccaccttgggcttgctataaagctgcagaaggacagtgctccttaaattcttaagagttctagtagttaacagagagaatctagaagcacttcttgaagatctttagaggtcccttggtctcaacaaaacagttcttgaggcagtgtcctaggtatttctgaggttttaacaaataatattatgggcatagtctttaatctttgctctgaagccctctcttaatttcagaatattagagaggatgggattaaaaaagagttttatttttgaacactgcaagtcctggctcctaaattttctctaaattttacttgaagagtaaataattcctttttaaaaaggtcatctttttcctcttgtatttattacagacaatgtgaagaagccaagaggcacttttagtattctgcctgaaacttctttagctagatcatctgattaattaggaatgtcttcgattttctaaattattgtgggaacaatgttgctaaactttctctcactactaacaaggatttcctttctcccagtttccaataacattttcctcacttttaattaagccctaattaacagcttcatcaagggttatgaggcttcctctaatagcctctttaagatcctttagactttcactaacattctccttagagtccttttctgcccactacttggtcccaaagccactctcacatggttttttattgccaccacatcttatttgacacaaaaaatacgacacaaaaaatatggttacagctatggctgtaaagcaattactccagaaaacgtggcataaataatcatttattttactcatgaatctataacatagataggtcttggtagagatagcttctgtctactccattggccttggctggggtagcttgaaggctgtgggctggaaccacttgatgtctcactcacttccatgtctgctggttgatgatggctattcctgagacctcagctagggttgctgaatgaaacatctatatgtggtctattcatgtggccttggcgtctttacaaaatggtgggtgagttccaagagccaatttcccaaaaaaagagagcatcagaaggaagccatatcaccttttatgacctagttttgtaagtccacagcattatttatactacattctatttgctgagatagttgcaagtctttcccaaggggagggaaaacagactccacctgttaatggcaagtggcaatttccagaagatcatgtgggactggaaatattggtatggccatttttggaaagacgtttgttatagttactattttacacagtgttgtcagacaggcttctccaaaggtggcatctgaatacccataaaagtgagggagtgagtcacattgtattcgggaaagagtggtgaaaacaagtgcaaaggccctggggcagattataatggatgtgtttgaactcgtttggctggagtcaagaagacaagagagagaatagcagtagtggttaagtacagagaagtagccaggggcttatcatcgagcgtcttgtaagccattgtaaagactatagtttttattccaagccatgagggagggtggttaagagaaaagaaattttattggacttatatcttaaaatgatcacttactgaggcacaatgcccaggagtttatagtgtagttgctatcactgtgaagatcaaccacatggagataaatcggaatggtgtttattgctacacacccagagtactcaattatatttgagccaagggatgagtgataaaccttgggctcttgtaaatgtctttctagaatctgtatttggtttaaagttgcatttgtactttttaggcattcttaataatgtttagcactgtctccaagcaagcattctctgcttttgaaaaaacttttctatgtgtgggatggcaattgtgatggattgttcccttttaacccccaggctctactctccttccatatcctgctatgtgccccaggaactatttctatatgctagttccataacctcctggacctctggctttcaggtaggtggccaatggaaagttccagcagataaaacagagggaggagagtaagatcagggtactcattcccctggtcccctcttttcacaactatctcatgacagaaggtcaaagcagcctgttctacatgactctaagttccagtagcctctgtgtccccattaggcctatgggtgatgacaacttcactagtgcgagtccccaatttatgcactatcccctgtggttccctacactcataccactgtaaacagactctttgcaaataaaacctcctcctcaatctcattttgcatgtgccatctgcccctgttgggaccctgagccagtacagtgatactgaatctttaaaaacttaaaccagggtattcacgcatttaattttggtctacttgccttttctagttgtcctcttcccttcccctccagtcttatgacctgtgagggtgtaagaatatgtataaagagacatacacaggatttcaggaggtaatttatccaggagtacaactctccaacctgggatataaaataaacgaatagagtaaacctagaggtgcctatttgggcattaaaatccatgtgaaactggcacacagatttgccttatattagtgggagaagattatctgctaacatctttactccctatttccccacaaaaccattgaaagtgtatcatcacctatcaacattttataaagaaatctgagcagagggctaaaagaagcgaaccttacttatatctgatgacgaaactctaaagatgtacaaaagctctggaagtggggtgggggttggggaacaagcttagagtccaaagccttgcaaataaacattctgaatctcctgcaatccagtttaacatcagcagattgctctcacttggttcttgggcctttatatttttcttttggttagctaattccccacctaccacctccatctttctttttcttttttcagaacagagcagtatagagaagatctaatggtcaagtttttaagcacatggcacatttctactttttataaaaagaatattattgtacagtttctcttgcctgaaaaacgcacttggacaaagcccagcactggtctcagcaagtccttactcaacaattattgaaggaagggctacactttcctattagaggccaatttaacatctggcttaaaatggcatttggcttacaggctctgaggcaacctcttctcattccccaagaaaagacctgtgaagactgaggaaaatgtaaagacttaaacaatagaaagtctaatgggactaattccctggaaggagttggaccaagaaaaatctatgcaaaatttctcccatggcaaccttaagcttggtgctgcctgagtcagtcaggataaagatggggatggagagctgctgaaagcatatgctagtcttactgtaatagttaggagcaccattcccatgctctggctatgtaacaaattagcccaaaacctagtggtttcgagcaatggtaatcatttattatctctcaaaatttttgtggatcaggaattcgaacagggcacagtaagttcagcttgtgtctgctcactggtgtctacagcctcaggggaaagactcaaaacctagagcctggaataatctaaaagcccatttactcacgtttctggtggttgatgctggctcttgattggaagccttattggggctgtcagccagaacaaaccatgtagggcctttccatgtggcatgagcttccttacaacatggtggctggattctaaggggaagtgtttcaagaaagaaggagagctgggccgaaattatattgccttttataatctgtccttggaagtcacacagcatcacttccttcagtttctcttggtcaagacacttagcagagtctacccaggttcaaagagaggaaacatagacccccctgccggatgaaggggtatcacaatacattgtaaaatgtcatgtgggatgagatatctattttgatgctgccatctttggaaaagacaacatgacaagatagggcctcccagggtgagatggcttgggttggaactcttgctgtgctacttgctaaccttgggcgagtatgaccttgggctagtaaatgacttgaactccctggacctcaatttcctcatagtattgatgtgaagattcagtgagttacatatcaagcaattagaatagtacttagcacatgttaactgcctaaaaagtcaggttttattacataatgtagctgggggatgctctgtcctcaccacccacttccatcttttcctttctctagcaggaaggaagggtcttttagcataacaagttaggttagtgagagatgactgatactgcaataagaggcaggggtttattagtctcataccttttctcatccaaagaatctgaaacccttagcctggtcctggtcccttggaggcaactgctgactacagggaaaatatggtctgctgcagataagggctcccaaattagaggatctagattagaatttatgttctaagtctctggtagtagcagtttgaaggatagaagatgaagctgagaagctatggagaggtgaacagaggaagagaagggtaacagaaagaaggaagacctctcaatacatctgtgaacctggccgggagcggttgctcatgcctgtaatctaacactttggggggccgaggtgggtggatcacctgaggtcaggagttcgagaccagcctggccaacatggtgaaaccccatctctactaaaaatacaaaaatcagccgggtgtgtggcatgcgcctgtaatgccagctacttgggaggctgaggcaggagaatcagcttgaacccaggaggtggaggtttcagtgagctgagactgcaccactgcactccagcctaggcgacagagtgagacgccgtctcaaaataaaataaaataaaataaaataaaataaaataaaataaaataaaataaaaatctgtcacctgattttgtctggcataaaaggcaacatagtaggactctgtgttcattatagcctactaatgagattttttttttaaatagacctaatggttgtacttgcctgctttctaaacataatgggcatagggaagttgcctctcttcttacctgtccagaaaaaaatgcaccaaaatagtaatactggcttttctgggtaagattaaaagtgatttttgtctttgttttttttttttaaactttcccaaatcttctatcatttcataattcaaaaaaatgttagggaaaacaatgacctcctgatccacagcagctgtgcctccacatcaataacgcttctgaatatcaattaccaacatgctctcgccagcatttcaatgggaagaaatgaactgaaccaaccctgtaggttgcttgctttcttcaagagaaaggaaagtttgcagaattgctcatgaactggaatctgcagaaccaccgcgatggggtgacttacagagtggggaagaggtctgctcatggcccagattagagtgaccctactgaaatggctgcctcaaaaacccaaggcccaccatgtccacctattgaaattaactaaagaattcaatgagtttcccagtgacccagctccctgtgagttgaacatggtttctgctatttcatttgaaactaccatagctcacagagctggaggagggttgcatgacagattgcagagcccagcccagccacacccccacctctcctctctgttgctaactgcacacacagaggtccttagggagggggaaatgcaataagaaaacacctgtgatttccttgcagaactcccccatggctacaatccaccctttcctctcttataaaagattccatttgctccatttctgaccccagggcatggacaaatggatggtggcctggtgtggcttctctgctcttggctgtgttcccccgcaccaattaatcaccataccccaatgtgacaggcccagctctttgcggcagctcatcctccggctgttccagtgattactctaaagccttccccagatgcaagaatttctcaatgtttttttcttcactattgctccatgtgctggctactgcaccgaaaggggctgtggttctcccccacattgctgactggtcagtaaggaaccccgaggacctaatttgagttcaggccctgtcacccactagttttgccatcttggacatgtcaattgagatttccctaagcttcctcatctttggagagaggataatagtaactacttggccatcttcgagaagtaattgtaataatctgatgagggattttaaatcattttttaaaaatcccttcttggaattgtgtttttaaaaaaataaaatatatgggactgccaacaaaaccaattgtattaaaatacaattttcaaagtattaaatcaattaatataaaaataaatttatgttagtgcattaaataacaagatttagcagtgggtctaaaaaccacagtgttttcaagctagtgatgagcctaaatgatactttgagatatctacaatagtagtgatgtaatatgaaagtatctgatttcatttggtgacaaagtcacaggtactgccgggactgtgacttgttacttacattcataattttaaaaaatgctaagttttagttagagtttagtggaaaaaaaatttatcatccaagtttagtctccctaaaattgattcacatattcctgtgggtccacagactccaggaatcaagaaactctaataaaaatgagataatgtatgtgaaaatgctttgtaaactctgtggtttgatgaatttgaaagatagagaaagattctcaaataagccatctggttcaagtttctttgtatctttagattcctcctatgtcagtttccttgagaaatttttgggagttgttaggtttcggcaagaaccatccttacaacacaggtcattaatatccacttgaggtctgaagaatcaggtctcagagttagcccatcattttccctatcctcaggtaaagcaagcacgtctctagctgtggttcctaactcaccacattaggatgacctaggtgggtgagagggtggacagagtgcatgttgaacatggggttccttaggttctcccccagtcctagggaatcaaaggtgggcccagtgactttcttttgtctgtctttcttctattccagatacattctggattattctaacacacactcaagtctgaaaacttcttgataatggaaaattgcttctagtattatcattcttgtgtgcagaagcagagcttttgtctgcgcagcccagagggtgggcatataattttctggaaatttcatagcttgattattacctgagcccacatcaaataaaccagaatccgtgctcccatggggacccgtaatcttttaatcaaacatctatcccagttaggagagttggaaaataagcatctccactcaaggcggaatcccagttctattatcagcttggtaccacagggacccttccaagagtcacacataagtaagcaaaccaccaagagcctgtgccctgcatgccaccacagagataccttctggagtgtcagaagagtgacaccaaaaacctgagctatgccagatgttgagggttagtgggggagatcaacgggaccaaaggtgggggggaggtagagaagccttacttcattttggagagccttccccaaacatgaagatcccaattcagggatctgtgacacaccaggcaatcagtgcttccagatgttttctggtctcaaaggcagggcagatgaaaagaagagaagaacattggagatagtgccacttctgaggagaagctccctggttcatcctgcgaaagtatttctttctctactcaagagcttgaagggggcgggttgtggggggcagcgagaaaagacttttctccttccagagaaaaatggagacagagcaggcataaatgatttccatcatggggaactgatgatttgagaagatatttgccctatgcagataatgtcagaggaagtcaaaggtatagggttgttagagagggacacaaccaggtactaggaagtatttttttcaaatgcccatttcttaaagatttcagcaggcttctgggaatgtctggcaccttctccatatagcaaaaccaagagcattttgaggggattgttctggaaccctttcaaagctcctgttgttgcagacatttgcagatgtctcctccatctgccagggattttgaacactggggactgtagcaccatgtgctaggagcatggatccctgtgagcagagtctaagagtttggtgtctgatgtgcaccaaacaccacttccactttccccaccccagtggcccctgtctttccacttctagactgttctgctctgcagagagagtctaggtgacttttttgctgggagagaggtctcaatttctccctttaaaaaaaaccacacaagttactctcatttccctggttcctttggaagaaaatgtgctgaacacttggttctcgcaagtggcctcctgcctgctttttgcacatttaagggagaaacagagcttaaatcaggaggcagcaaactttggcctgtgggccaaatcctactgctacctattttagtaaataaagttttattagaacatagccatacccattaatttacttgttgaccctagctactttttagctacaaaggcagagttgagtagctgcaacagggattgtatggaatacaaaggtgaaagcattttctattcggccccttatggaaaaagttttctaactccctgcttaaataaaggagacagagcagctaaataaatggatcaaagctgctgaaacatgggtcagagcagctgaaaaataggaacttcaaaaattaaaggaggacaactagatttctgatcctgagagcaaaaaagcaagagaaatggctggtttgcaatacatgaaggaatacatactgggtacttttcatgtgcctgactactgtgccaagcactttacatacattctctcttttaaattctacaagtgaggtatattactgtcatcattttacagctgtgaaaactgaggcctggagatgttgagtcacttgctctggtcatccagctgataagtggtagggtgagaattggaacacaggggtgactttagagcccaaagtcttgaccatgaggctatcctgttgacaggctccatgtcataggaaacacggaatggctgctttttcaactgctcaaatcagtgacacccaaagtcttagcatgggctgcagctacagcaggatccccagaaactgggattccttaagtctttgggaggcccctgaagttgcactgaaaatgttctggtgcgaggtggggaggggaagacttcactgcccagtcataattgcttcccttggcctcattactaggttttaagaggaggaaaacctaatattgccagtcacattgctgcttgctattttgaaaatgtggtaggggataaggttgaaacatccaacatttaaccctgaaactggcatactaaataacactttttcacgtttctgcatggtctttcatccaaaactctcagacgacttcacaagcagttactatttactattatattactcccttgggaactataatggagtgtggctgcttcgagacttgaagagtccctttaaattgtataattttctcctggctctttctggctaacgcatgcacttcactaatatttgaaagaaaaaatgttgtgaacctattttttgtttgtttgtttagattggcgtttgcctaaattagtatttcacgcacagcctgggttcaaaagactattgtttatgctactgggcatagttaaaagaaagaaaaaataccctccagggcaaactaaaagctaaatagcactcgatccacaatctccgtgtaaggactgatgagtgccaaaacacaagatccacattcagtgtcagcagtaggggtggtggttgcatgctcagcttttcattttcatggggaaggtggacatcttcaggtcccatgaaccaagaattacatgtaagtataatcattaaatgagcaccaactctgtatgaggagctgtatcggtggcctctaaagggttaagtgtgaagactaaaacttctgatttgtacttatttttaatctcatcttgttaaattatgcttggttaaattattctttataatgtacatatcatgttcaataatgcatgactaagatataataagcagatattcaacaatatttaaatgcaggggtgtgtagataaaactcacccttttttgtttttttgagacaggttctcactctgtcacccaggctagggtgcagtggtacgatcttggcttgctgcaacctctgcctcccgggctcaagcaatccttccacatcggcctcctgagtagctaggactacaggcatgtgccaccatgcctggcacatttttgtattttttatagagatggggtctcaccatgttgcccaggctggtcgcgaactcctgagctcaaggaattcacccgactcggcctcccaaagtgctgggattacagacatgaaccaccgcaccaggccaaaactaactcttttacatgtcttatctcagcatttaagcagcactagaccctcaagagtggcaaactggatgcctgggtggaccacccactctggttaagtgtcaccatgtgaaaatgaggacccagtttgtcctaatctttaggttttttcaagagaagctgaaagttaatttttatgtgaaatcttgtgatgtatgtgtgaaatctcactatatttaaatacgggaaactttgaaaggcaaaactgtgctggccaaaaaactctacatctgtgggccagatttggcccatggaccgctagctttcagtctctacgctggatgttatatcaagatttctgtggttaaatagatttgcaaaatgcaacagaatgggatctttcttcaatattcttgatgaagatcaatacattaaatgctcggagaagtcgtgtcagaatggaaactatttagcttgatttaaatgactgctcccccaaatcaccagtctgtgtgtgctcctcacattacaataacctgtagaagtgtggttgctaagtacactggggaaagctgcataagtccatttgatcctgcaccagaaactgtgaaaggcaggtactgctgttattattcccattttatgtgtgaaaacaactgagggtctgcaaggttaagaaaattgctcaggctcatatagccagatgggggacaggtgcttcactgactttaaaactgaaatggtttctactacatttcatgactaggtccgcaccacccccacaccaaaaaaaaagtggattttgctttttctatgactggtacaataacaattttaggattcaggatgtttatggtaggattgttttttaaaaaccccatgctctgttgaaatatatcaaacggcactggtttcatcagccacataggcacagaggtctcattttataaccatgagctcggatgaacaacatctcccctggggaggcattgtgggttctctcccgatgccctgccctgccctgggtaatctgaggctcctgggcccttttgggaccttcccccaatccttccctccctccctgcactgcatcacctttctcccccaccaacacccaaccccagccctggtttagctaggctttggccatctccctttgttgcctccacagtgggagggaactggaacaggacaggtcagggctccagccgtatggggaggaggtttaggggacctcgtgtggagacaagaccctggaaacaggcttggggggctggggtggggtcagggtgagaagcagtgagagaggcctgaaatgcggcctggcccctctcataccatttgggcacctgacgcagaatgagggctgccatttggacaggcttgagccaaaccccattcctgggagtgaggcatccctgctgtgtctgaaagaccccacagaggatctttcatccccaaaagggaattcactgctttcttggcaatcacttccaggcttaactaactacccttaacaggagaaagttcattctcagctgcaacagaaactcttcctgctttgtttttcttcagtacctctccagagacccaggagggatgggtgtctctgccctccatattttaacctctgatgaaatggagtgcaacagagcagagtaactaagagcattacacagagctaagtttgactctcagagcattcacaggctgtgtgaccttgggcaagttatgtagcatctctgaacctcaatttcctcatctgtaaaatggggtgaaacacagaatgtctaagagaaacagaagcatacatccatataaaaacttgcacataagtattcatagcagcgttatttgtaatagccccaaagtggaaacaactcaaatatctattaagtgatgagtggataaacaaaatgtggtatgtccatacaatgactactatgcagctatcaaaaagaatgaagtactgatacatgttccaacatagatgaattttggaaacatgctcagtgaaagaagtcagatgcaaaggatgacatattgtgtaattctgtttatataaaatgcccagaacaggcaaatctatagataggaaacagatcagagttgtctagggttgtagggagggggaaacggggaaatgactgctaatgcatatgggatttccttttgggtgatgaaatgttctaacattgactatggtgatgactacaaactctgtgatatacttcaatatattcactgaatataatccactgaattgtatattttaaattggtgaattgtatggtatgtgaattatatctcaataaaactatatttttttaaagggatacaaaacccatagtacctacatcatagaggctattgtgaaaattcaataatataatgcctcgaaagtgtctagcatagcatctgacaagcaatcgatgttatcttcaacaacaatattagtaataataaaaatatgtagttatatcttatagtatcatataaaacaataattatatgatacacaatattccgtgtaactatatgttaagtctatattatcataaaataattataaaaataatattttttttcaccctctgtctcttcctcctcttaaaactttgattctgggttgatcctccaattttttttaacattatcaaaattacttttgaacattttgaatgttatatatattacctaatatatacaacgtatctatcatagtatattatatattatgtatagacacattatgtataatgtgtctatacataatatagacaggacccgatccccacagcttgagacaatcaatgtggtgttcagaaacagaactaaaagggcatattttcctggagacacgttggctcaacgtgaaattcccctgtagcctcagtttccctcaaggcctgctaaccagagacctgaaggtggattactatccaattttacttgctattggctggacaaatctccctgttcatttgttgtatcaataaattagggtggaatgttagacacattatgtgtctatacataaatatataatactatgataactgtgatatatctttatgggattattactatacattgtcatatgtaataatatatattacgtgccatataatacattcagttgtataatatacaattattatgaaatatgatagtagtagtagtgttcaccctatgactggtctttcttttaacctttctgaatttggaatggtttctccaattctttgaacctttgctggcccctgatatatttggaaagaaaattgctctgaatttggagaaattaaattacagtaatgactctaattcaactgcctcgtgtagctcaggctggaagatagaaaaaatatcccaggccgctcctacggctgctcctgggagccctgtgagggggccaggaggaggtgggggacacgccgctgagggtcccggcgacacgccagggggccccccgatgcggataaagggctgtttcttcccagcctctttggaatgcccggctgccttttgaaaggggatccccaggactccggtccagatctggggtttctccctccttgctgttgatcgggagcgctgccgcaggtgtcccattttcattaaaatgcacatcagagcgcctactggagctggtaacaaagacaacattgaaaccgggtgtccgccttccgcggccaagcagggggcaggacaatgatttccccaggatgtgttcgctgcctggcttccccacagagcgctccgtcaggactcagtcatgggtgaatgccgggcttctgagaaactccagctgagcggagttgttgcaacttcagaactgtttctccaagtgagggaggaggccttctggaaggaggcaatcaacagtttcccgatccccacagcttgagacagtcagtgtggttttcagaaacagaactaaaagggcatattttcctggagacacgttggctggatctgaaattcccctgtagcctcagtttccctcaaggcctgctacccagaaacctgaaggtggattactatccaatttcatttgctattggctggacaaatctccctgttcatttgttgtatcaataaattagggtggaaaaaaaggaaatagtcttactttgcagatatctttggggtgcttggaggttgtacctgatatggtaaaaactttcttataatgaaatttatgtacgtgtgtgtttggggggaaaaggaatatatttatgaaagtttttttttttttttttttcagagagactgctagaaatagtcatttagaggggaaaaaattcaaattacacaatatcaaagctgtattgtgcagctacagtgaaggccatgggtagcccacgctactttctctacgtgggccaggaaagcaatgacccaacgctgtcccaggactcagggctgatgagtggaggaaaggctggacttctggacttgtttttttctgtgcccccttggcagggcattctttttttttttttttttttgagacagagtctcactctgttacccaggctggggtgcagtggtgccatctcggctcattgcaacctctgcctcccgggttcaggtgattcttctgcctcagcctcccaagtagctgggattacaatcatatgcgaccacgcctggctaatttttgtatttttagtagagatagggtttcaccatgttggccaggctggtcttgaactcctgacctcaagtgctctgcctgcctcggcctcccaaagtgctgggaatacaggtgtgagctaccatgcttgcaaagtatggtttgcccaaccattcatggtagctccgggtgtaaggttcacctcctcctctccactgattttggaaactgaggcttagagatattaagtgactttttccaaggtcacacagccagatagccacaaagctttaccattgtcatcatccacggaggctggttccaaagatggtggcttcttcggtgtgaagtttggggactagaactcctttgctgtgctgcctgagatgctccatggagccatttttctctgggattctaccatcttctcagagtgctgccaggaagttgaaccctggtccttcttcctgctggccccataggacccttcttcatgcctctccaagcccactctcaactgctaccctctttgcctctgcccttaaaaagacaggctaactctgctttctgctctgccacaaaatttagttggggctcagaagcccagaacctgctacctgcttaaatgaggggaagagtaaggggaaaatgtatatatagagaaaaaaataatgaatatgtcaaactattcttccctaggagaggaatagctaggtcatatggttagtgtatgtgtaactttctaggaaactgccaaagtgttttccaaagtggctgtgcgattttgcattccgatctgcaatatatgagagttccagttgctctgtatccttgtcagcagtattgtcagttttttaaaaacgcacttcagtacccgtgtggtggaatctcattgtggtttttatttcatttccctaatgtctaacagggttttgtctctttttatgggcttatttgccatctgtagatctgctttaatgcagtgtctgttcaaaccttttgcccatttttaaactggattgttttcttatgattgagttttgacagttctttatatatagtcatgtgccacatgacaacattttagtcaatgacggactgcctatacgacggtggtcccgtaagaatataatgaagctgaaaaattcctattgcctagttaggtcatggccatcctagcattgtagtgcaatgcattattcacatgtttgtgtcgaggctggtgtaaacaaagctactgggctgccccttgtataaagtctagcacataaaattatgtgcagtacataatacttgataataaatgactatattactggtttatatatttaatatactatacttattattatcattttagagtatactcctactttaaaacaaatttaactgtgaaacactttcaggcaggtccttcaggaggtattccgaaggcattgtcagcataggagatgacagctccctgcatgttattgccactgaagaccttccagtgggacaagatgtggaggtggaagacagtgatattgatgatcttgaccctgtgtaggcctagggtgtgtttgtgtcttagtttttaataagaaacgtttaaggactacaaatgtagtttttaaaataggaaaaaagcttatagaataaggatataaagaaaatatttttgtacagctttacaaaaagccaaaaggttacagtatgctaaagttaatttattagtgaagaatgaaaaacatttttaataagtttagtgtagccttagtgtacagtgtttataaagtctacagtgtataaagcatacagtcatgtcctaggccttcacattcattcaccactcactcactgactcacccagagaaacttccagtcctgcaagctcctttcatggtaagtgcacgacacaggtgtaccactgtttctcctttatactatagttttactgtgtcttttctatatttaggtgtgttcagatacacaaatgcttaccattgtgttacaattgtctagggtattcaggatagtaacatgctgtacaggtttgagccaaggaacaatgggctgtagcatatagccttggtgtgtagtaggctataccatctaggtttgtggaggtacactctatgatgcctgcacattgacaaaatcacctagcaacatgtttctcagatgtagccccactattaagtggcacatgactgtattctggttacaagtcctttatcagatatgtgtttcatatacggtttctcccagtctgtggcttgtcttttcattgttgttcgaagtgtagctactttcttctctgcatctcaaagctgccggactgttttattctctcctcaccaccgatcactttctgaaatgattttgtttactacagacacccccttaccagattgcaagttccacaaggccagtgacctcacctatctgaatcaccactgtattctcaagacttagatctgtgcctggcacgtagtaggcacacaagaaataattgttgaataaacagtgataacatccactaacaggaaaacagtttggagatttctcaaaggactaaaactagaaccaccattcgacccagcaatcccattactgggtatatgcccaaaggaaaagaaatcattctacaagaaagatacatgcactcatatgttaatcacagcactattgacaataacaaagacatggaatcaacctgggtgcccatcagtggtggactggataaagaaaatgtggtacatatacaccatggaatacctcatagccataaaaatacaccatggaatacctcatagccataaaaaaggatgaaaccatgtcatttgcagcaacgtggatgcaagctggaggccattatcctaagatattaatgcagaaacagaaaaccaaatatagcatgttctcataagtggaagctaaacattgggtacacagggacatacagatgggaacaattgatagtggggactacaggtgtctattgacaggagagagggagggagacaaggactgaaaaacttgtctactgggtactatgttcactatctgagtgacccaaaccttagcatcatgcaatattatacctaggtaacaaacctgtatatgtacccctgaatctaaaataaaagttgaaattttcgaaaggatgcagtttaaaaaaaaatagtgtaaaagtaatacgagaacttttagcactacctcttcaatttttatgttaattcaaatctgttctacacaatgtctattaatttttttaaacctggcagcgctgtttcagaaaaagatccatgttagctaacgtctaacagttagataaatttctgaacattgggccgggcgcggtgtctcatgcctgtaatcccagcactttgggaggccaaggcgggcggatcacgaggtcaggagatcgagaccatcctggctaacatggtgaaaccccgtgtctactaaaaaaaaaaaaataccaaaaattagctgggcgtggtggcgggcacctgtattcccagctactcaggaggctgaggcaggagaatggtgtgaacccaggaggcagagcttgcattgagctgagatcgcgccactgcactccagcttgggtgacagagcgagactcaatctcaaaaaaaaaaaaaaaagaaaaaaaaattctgaacattatactgagatgttgtttactattaaaagtgaactaaatattaaaaattgtcagtatagctatatgtctgtagttgtagcactactgattgacttaaatttgcacacatgaaataaaagaatacagtatagcaaaaaacaaaagaaaacaacaaaaccaaaacatctgctaatacctcctgagggcttattaggctctaggtactctgctgtttacttctcatggtttacatcatctaaccctcagagtaacactattaggtagcttctattattacttctacttaataaggatgtgataataataacaaaggctgtgctgtttggagctcttagctccaaatctaccatcctctgccatcatgtgatgctggagctgatactctacaaacctaatttctgttttgccagctgctctttgttaggtcaccagtaaggggcactagagggagcttgcaggatggagagaaaagggacttgttcttcttggtctggcttgctattactgtcgggatctctctagcatcaggggtttaaagctggcaagtccttggttccaggagtagtagctcgttccaagttgcagtttttcccactatcagaaccaggtgcatcaaactctctcagagatgccaacaccagcaggtatcccctcctcaaaagcctaagatccagcattgtggggtccctctcccaagtcttttaccttctcttcccgtttctacccccatctctctcttttaaggttttctgttacgttttaacaatcctgacctctttgtccctccaacagctggggtggtagcagcttcctgcgattacttcctgtgggatactctgggctccttttttgccttttcagttttctaagacatgtttaataatacttggtgttaaactctaatacaataagtgggatcttgactaacacaggaaactgagcgcagagaattaacaatgtcaaaccgacagcagagcaggaattagatgcttacacaattagcttcaatagaaggaagaaagtgagaaatgcccctagaggggaacaaacaaaagaaaagggtaatttggcaggatctattaaaacctattacaatgtatccccagagaatgggaaaagactatatggcttgggcagctcctacttacactggggagacaatctaataaatgtccttttcattactgtttaagacccaacccagctatggcttcctccccataagctgcggtggcagacactcttggatgcttcccagtaccaagaagctctttcttcctagctggtgttttcttacagagggtaggaaagccagaatcctgctctcactgtcagtgtcccgtcaggaagtatacaggggagagccaggacttatgacctagttctggccaaagaaatataaaaggaaacttctggaggaggcatctgagaaaaagttattttcagacttgcagagtgtccttcattaagctccccaaccttttttgcttccctggctaccttctgcttcctgcccttgaatgtggttgagacaccggaagctgtggctgccatgttggactatgacaagatgaaggatgactggaaaggacaggggtaatctgtattagtcacagtgcttcagagaaacagaaccatcaggagattatctatctatctatctatctatctatctatctatctatatttttttcagagatggggtctcactctgtcacccaggctgaagtgcagtaacttgagcatagctcccatcagcctcaaactcctggactcaagcgatcctcccatctcagcctcccaagtagctaggactacaggtgtgtgccaccatgcctagctaatttattttaattttaatttttgtagagatggggtgtcgctatgttgcccaggctggcctcaaactcttggcctcaagcaatcctcctcctctgcctcccaaagtgctgggattacaggtgtaagccactgcccctgacctgagagatatttattaaaaggcattggctcacatgattatggtggctgagaagtcccaagatctgccatctgtaaggtggagacctaggaaagccagtagtgtatgtagttcaaagtcatgaggagcaggtagctgatggtgtagattccagtctgaatctgaaggctgagaaccagcacaccaagggcaggagatgattcttgtcccagctcaagtagtcaattagttagattaattttttacataagtatgatcattctatatgtattctgctatttgattttttttccacttaacagaaggggcaaatctagcctttgtctgcctttttattctagtcaggccctcagcagattggtgacacccattcacactggggagggccacctgctttactcagtccaatacaaatgcttatttctcaaagacatgccccaaaataacatttaatcatatatctgggcatcccgtggcctacccaaggtgacacataaaattaaccatcacagaacttatgtcctcagtgacattgttgagatgaatgtggtacacaattgtaccatttgatttcttgctaagaaactaaaccttatggtttaaatcactattacttcatttatttcttgtagctgaatacattatacttggtacatcttccagcccctcagctgggagtatgtttcttttctctaggtttaccaatcattttttgaatttccctatgattttgctttagagcctggctaactttctttcatatattaaaaagatttgtaaacgcatcttctttgctctactagacttgaagctattaaggccaggtgctctaattcatctgggtattccacaggatttctaggagagtacctaccatacctaaaaaatccacgtgcatatcgtgtacctacatatgtgagttatagctacctcttatattcagtttacaattgtgttgtgagaagaatcttagttaaaagcaccaactctggattcagacagaactgagttcatatgttgactccaccccttattagcgaggtagcctagggtaaatcctgaccatatctacatttcaccatcctccaaggcccaattgaaatattttctctacgtgaaaccacctgtgctctctccctcccaaatttgaaagcattatttccctcttaactcttcactcccttttctgaaatgtagacttttaaattaattttttacgtaagtatgatcattctatatgtattctgctacttgatttttttccacttaatatatcttgaaaatcctttttcagttcaacatatatggacctaccttatctccatagtattcaatactacagatttatcaaaatttatttaattattccattaatgaatatttctgttgtttctaatttgtgcacattaggtacaatttcactattagtgtgcatgcttctttctaccaatgtgcaagtatctctctcagggagacaccaagatgtagaatgactggtaaagataagcacatctagaaatctaacagattgtaccaatgccttctaatttggttgttaacaatagtcaaaagttaaaatcatttcactactctttctttgactttacttaacttttcagattctgtaagagtaagaataagaggcctttcaactggtcagagccacttgttctggtttttcacccatcatcctccacactccactccccatctgtggggcagtttggtagatgagatggaagaggctgggcacagtggctcacgcctgtaatcccagcactttgggaggccaaggcgggcagatcacttgagcccaggagttcaagaccagcctgggcaatatggtgacacctcgtctctactgaaaatacaaaaattagcggggcatggtggcgcacacctgtaatccaggctactcaggaggctgaggcaagagaatcacttgaacccaggaggcgggggttgcagtgagccaagatcaggccactgcactccagcctgggcaacagagttagacttggtctcaaaaaaaaaaaaaaaaaaaaaaaaaaaaaagatgagatgagatgtaagagcataggctttgcagttcaccaagtggctcggacactgtagctgtgtgaccagggaaatgttgccagacttctttaagctgatgtttctattatctgtgaaattgcatgagaagaattccagaggactgaggagactgaaataatgcttaaccagcctctttgccttacgaccatcttctcttttccctcctttcctccaccctttcctgtcaccttggagaccttgggacacttatatttatactcaaaatcatgactggtaaagtgagtctgaaataaaaatgatcttctatagataattttattctcttgagcttctacaacaggggtggacacactacatttgtctctaaatcagtctaacatctgagtaaatcctacccatggtaagcccccaattaacaactcttgaaagatgagtggattctattttaactacagcagttcctgggtaaagcttttggtggggatccaggactttttaaacactaaaaacaaaactaattcctatttgccactttgacaatattatattcgaggttaatctagggatgcaaatttctgaccaaatccaaaaaaattgatgtcagtattaaaaacaaacagagctggtcgcggtggctcatgcctataatcccagcacttggggaggccgaggcaggcagatcacaaggtcaggagatcgagaccatcctggctaacacagtgaaaccccatctctactaaaaatacaaaaaaaaaaaaaatagctggatgtggtggcacgcacctgtagtcccagctactcgggaggctgaggcagaagaattgctcaaacccgggaggcagaggttgcagtgacctgagatcgcaccactgcactccagcctgggtgacagagtgagactctgtctccaaaaaaaaaaaaaaaaaaaaaaaagagaacagacaggatgagattcaaaagaatccggtgcaataccaaggaggaggaagtgctgagaaaacataacgccatgtattggagaggtcagacttgggaatcaaactgattaatgggtctgctgaagagcagatagagttctttagaaattcaactagagtagaataatctcagtgtcaactgccatattaacgtcaagtaaaagggtctggataaaaatgtgactttatagctcttccaattctgtgcacaaggtagctggtctgggaaggattacattcaagtaggtgaaatgcacagactcttcatgaaagaaaccatgacataaaaaaaaatcaacatttcagttaagtaaagattgcttaggtagaggtaaaacaatttagcatattatgaaaaactccttgttggcattttaatagccttcatattaaaaattattacttcccctaaggagaaagtttttagcatgtcttatgaacctggaactgtaagaggtttctggattttggacagaggcaaagccaaggataggtgaaagggatcaatatagctctcaaaagaatttaagtgccactaagtctccttgactttaccaaacttctagcaaatgcctcacagtgatgttagtaaatacagaacaagtctatcattttgggaaagttttctttttaaagactattatggcaccagaattaatgcttatgaaattttagatgatgattcaggcagaatgataatgttgggtaaacgattttcctcccaactttgagtctctgccacgctggccatcacacatattgtatggatctgccaacagtaccttccttttctttcagagtagaaagattaaatgaacttcttcctagcacacacagatggcttatcagttggcggttttcttcaagtccctacttgcaactcctcaaaacttatctaaaaatcattaccaaagctgcaaatacagattttcagatcaggaaatattacctgatttatgaatcgtacacatggggtataactgacaaagcctcatcactcatgataggctcacccgctctccttccctgttcacagctcaaaaacctcatttaagatgagattagaacaacacagcttcattaaccttggcagcctggcagatggcattggccttcaacccgggaccagccagtgagcctggtgctggctgctgtattgatccatgtgtcattctcctgaaagcaaagctgcagactgaattccttttggtgaaattccattccaggcaaacacctggattcaccccagtgattggacctgtgcaggcttttgtctatcttctgagaattactctgcaaatgctggaagaatcagggtttaggaagctccaaatccaaaatgaaaaatgagatctggcatatgtgctacaaattggaaagaccttactgcttgtgatatccgtgggcccttaatcagaaaactttaatttcccgcttcccttttctcttgtttgactttggattctgtttcaaagtttctaagtcaacaatataatcaactgaacttagaacaacttcctgctcctgacaggaagaaaaaaagaaatctctttgtttctccagtggttggggagtaaacgaacctcccagggaaagaaaaatcctttggctatatttctcttgcttgagaaagagcagaacaaggagggtcttctgattttgaatccgttgcatacactggagttaaaagtcgagttgtctatagcagccaggcagataagtggttactgttcaccaatctatatgctcccctgtatttcccagtctccgttgcagttagcttaggaccatgtgactagttctggccaatgggctgttaggggaagcttctcgtatcactttcaggtcaaggttgctaacagggggcctgccttctccatctccttcctctgctgtagtgactttggaggccacatcttccatataagagagagctatctggcctttgacctatagtccacattacataaagtagaaataaatcttcagcatgaggccactgagattttcaagatttgtctagagcagctgctactcaaatgcaacatcttcagttgtatattttaggataagacacactttatcaaatataaagacatgttcttcactgtcccaagagaatattctgtctgctattatttcttaaataaattaacaatgatagtagttaatatttattttatactcacaatgttcctttattatccccagtttacttatgaggaaactgagacacagagaggctaactcatttgcctgatgtcacatagtaagtagaagtagggttctcagatttggcaaataaaaatacatgagatacaattatactaaaaattattcattatttatctgaaattcatatttaactgtgttttctatattttatctggcaactcaactagaagaggctaccagatttgggtccagatagtctgacttttgaatccacaagcttaattatatgttaccagctgcttctcagactatttttagttttatatttttattaaaaatatgggtaaaaatttttctttcaattctatttttgaaaacagactgacataaacagagcaagcacaaagataaatagctactgtgttggagctacaacatcagacatacaacagggattggtggggactgtggcaagttggagatcatatacttcatatacagagagcagtcactactatgctactatagatagttgccacgtgggaacccaggcttcttctaaaagaagtcagaaatctagatttttgtacgaaatcttcccattttaaaatgctggtaacttaaaaaaaaaaaaaaaaaaaatatatatatatatatatatatatatatatatatatatatatatatatatatatatcccttcatgggtctatacagttctagagaaaaagaagagctctggaggccgaaataaacttgtagatcatcaggttgtcatctctgtattcacatgaagaatcttttgaagacactgttgttatttgtctttaggttgctgggaagcctctatttctgcatagccttcctatggaggaaccagtcctaggattgcaatttaaaactccaaatcatgattaggtatatatttgatttcagtcaatgacttatctttgtggtttggattgtgttttcaagtccctacttgcaactcaaagcttctgctaggacaagacattgcgctaagcactataggactatagataagagcaagtttcgatgctcatcttctctcctatctcataagtcagaacaagacaaatagtacaatgccataacagaatggggataggcagttaagaaagggacagacagacttagtacgaagtgtatatgaacaaaggagaggcatctgggtgagtccatttggaaagtcttcattaagaaggtgacacttatgaaagaccatggtagggcaggattttagtaaacttaaggaaggggaggcgagagaaaagggaacagtataaatgagggcctacacttgagacagttttcagcttggctgctgtagaaaatacttttagaaggtggagcagtatcaggttggaaaagtaggttgagggcctcaaatgctagaaaaaaggaagattaaaatcaaaatagcatactctcataatataccttgacaccatctattagcatgttactttttttttttttgaggcggagtctcgctgtgtggcccaggctggagtacagtggcgagatctcggctcactgcaagctctgcttcccgggttcacaccattctcctgccttagcctcccgagtagctgggactgcaggtgcctgccaccacgcccggctaattttttgtatttttagtagagacagggtttcaccgtgttagccgggatggtctcgatcttctgacctcgtgatccacccacctcggcctcccaaagtgccagaattacaggtgtgagccatcgcacccagcctagcatgttagttttttatattccaaagccctcactgatattttctcaatttgttcacatggacaaataacatagctattactagctctattttacatctaggaaaattgagtcagagaggttacccagttttcccaagttagcaggaaatcagagtgaaagataagattaacatgtagattatctaagttaaaggttcacaaactgtctgtaaaggtccagacagtaaatgctttcgtctttgtgggtcatgcagtctccactgcaacttcttaactctgacatttccaggagaaagtagtcataaacaatatgtgaatgaatgggcatggctgtgttccaataaaactttacttacaaaaacaggcagcaggccaagtttggccctgactgtagttcactgacatctggtctaagttttgtcataatgtggtttcataggtgctatgggaatttgctttgttcactgtagtattttctgtgcctaaaatagggcctgaattataacaagggcttaatatgtgtttcttgactttacaaagtcacattcctgaaactttacacatgaacaaccagatttaatacgtttggcctggaagtcatcctttctacagccatccccctctacatatattcaattgcacccagtcctagtgatgttattttaaataccattctccacatccacttctgccactgtgacttcttgtctgaattatttcagcagactctcggtctccacatatagtcactctgtcaccatctaattcagactcatcagggaagcccgatctgaacagcaggcactccctacttaaaactcctcaatggactctcactttattttgaataaaagccaaagtgttagtctaaggagtccacttacaatccaaagagctcctgataactctctagtgtcatctgtgacataccctgtacccatcatcactctaatctctgtggtctgttctcagagaatatggatcgctttcctgccacagggcctttgcacagaccatttctctccttcatttcaccttcctccatttatctagttgattctcctgtagtgttcaaagctcagctgccttgttccctctaccagataggacaccttgtctatcacaacaatctcacaataacctcactgactacattataaccaattatgaattatctgatgcattatttaatgcctctcttcctgccacttgctcactggtatataggctattaccagcacagtgtcttccatgtagtaggtgcccaatacatacttgttgaatggaagtataacatgacaaaattttagttttggagaagatcttagaagccatctacttgaatcttctgcctcatgcaacattctcaacgatttaagtgaatcgataaggtgcagggcttgtcctgggcttcagcaatctaaagcagccttatttttctgtatttgctacaccctcacaagcactgttctgaaaaatgctactcacaattcccaaaagtattcaaggttatggtaactgtgtatatctctcctatggtgagtgattccccccaccccatcttccacttcatcatttcccaaatttcttataattatcaggtgtcacttttatgaataaaagtttcataaagttactttgaattcatatagggtcttttcagtgatttctatattgtcttcccgtgatgcttattaaaaattaatgattggccaggtgcggtggctcatgcctgtcatcccagaactttgggaggctaaggcgggtggatcacttgaagtcaaaagttcgagaccagcctggccaacatgatgaaacctcatctctactaaaaatataaaaattagctgggcatggtggtgcatgcttgtaatcccagctacttgtgagactgaggcaggagaacctgggaggttgaacctgggaggtggaggttgcagtaagccaagatcacgccattccactccagcctgggggacaagagagaaacttcatctcaaaaaaaaaaaaaaaattggcccggcgtggtggctcacgcctgtaatcccagcactttgggaggccgaggcaggcggatcatgaggtcaggagatcgagaccatcctggctaacacagtgaaaccccgtctctactaaaaatacaaaaaattagccaggcgaggtggtgggcacctgtagtcccagctactcaggaggctgaggcagaagaatggtgtgaacccgggtggcggagtttgcagtgagccgagatcatgccactgaactccagcctgggcgacagagcgagactctgtctcaaaaaaaaaagaaaaaaaaattaatgatttaatgtttgattatgaaatacatcaaatataaaaaaccagtattttaaagagatattggagaaaaacaatcccaccaaagtattttctctactctcacatagccaacacacaagacttcatctctggtcaccaaaatgtgttctccccaccagaaccaattagttctccagtggactctgtgggaaatctcttgtagacaccagtgggatgttctccaattcaattcaattctgacactatctacctggagacagcatcagatcccattggttgagggctcagtccacaagactgcccccaacttccgtgccaatggcaaaccccaagttgtttttacctgtgataacctctgaccaattggctatcagtcagtgttcccattaccctatctatggattccattaatttgctagagcagcttacagaactcaggaaaacacttagatgtattggtttattataacagatttcacaaaggatatagatgaagagacgcataggtcaaggcataccggaaggggcatggagttttcatcccctcccacggcgagccactttttaggaattcccaggtattagctatccagaagctctctgaaccctgtccttttgggtttttaaggagacttcattacatagtcaggattgattaaaccactggacaatttaaccttcagcccttttctctccctggagattggggggtggggctgaccctctaagggtggcttgttcttcctgatgaccagcccccatcctgaagctacccagcaagccccaggctgccagtcatctcattagcatacaaaagacgctcatcactctggagagtccaaggattttaggagctacaggacagaaaactgggcgaagaccagatatatatttcacaatattatatctatgaaaaaacaacaccgtatccacaactcaagcctgacgctttgtaaagacctggctttttgttttactcttaataacaaaaggaggctgggcgcggtggctcatgcctgtaatcccagcattttgggaggccgaggcgagtggaccatgaggtcaggagtttgagaccactctggccaagacggtgtaaccctgtctctactaaaaatacaaaaattagccgggcacggtggcaggtgcctgtaatcccagctacataggaggctgaggcaggagaactgcttggacccaggaggcagaggctgcagtgagccgacatcatgccactgaactctagcctgggtgacagagcaagactccatctcaaaataataataataataataataatagaagttattatattgaattccatttttcagatggataataagcaaagagtttagatgactcttccatggtgatacagtcagaaaagggaagaaactgggatcgtactcaacacaattcaagcacccacacagcgtatcgtcttatattctcccagactctgtgatgcacagagtagctctaattttccctttacaatattgctgaaaggtggtgaaggctaaagtcttttggacagcattatataaattgaccttgaatggagtgcattcttgatgtcttctcttgagacatcatcaaatacaatgattctttggggaaagacactattacgtttttctcacaaatggaaaatctgaaacagaagcaaagtgcatggctgtctttggatgttcgtgttaagtagctgacttttaggcctgctagtcttttactgtttcatcggtgtttagttgtatgtacaaggaaaatgtcaattccggactttaaatttcagatattatatttccttaaatgaactaaagggcaaagggaatattcttcagtggcgatccattctcccctttctgtaatctatttttcattagccacaagtcaagggccagtttctgaaatgcttgtctgggtatcttgcaatctcattcgaagtgctgagaagtcaagacagcctctaggagtgtagggggaacgtgttgataagtgctaagtgctgctactttgaactgcacaattcccctcaatgggcacatattaactctagctaaacacactagtgccacctactggaaaaaaatatattttaattaaaattaagttgcaggctttaagtctgcaatactgaaaaatgcctctctaggacggcaatttcctctgccaaagaaaaacagagttaaaccagctcactgaaggaaacttaggtgatctctaggtattttgttttggaaagaaaggctttcatttttcatcctgatagcaaagaaaatattaaataataatgaaatattagaccaactaacaccatagttcaggaatgggcttttctagagttgttgcaggattacccctgatggggctgagtttcctggggtctgagcacagagggtccattgcatggtttgagggggctttcttttctcatgtctgttatagaggaacccagaaatctggagaagagaaaggaattgccacagggaacttagtttactttttttttttttgaaacaggatcttgctctgttgcccaggctggagagcagtagggtgatagtagcacattgcagcctcaagccatcctctcacttcagcttcccaagtagctggggctacaggtgtgcaccaccacgcctagctaatttttaaattttttttgtagagatgaggtcttgctgcattgtccaggctggtctcaaaccctggcctcaagcaatcctcccacctcagcctcctgaagtactgagattacaggtgtgagccactgtttgcctttttacagaaggagacaaaaaggtatctttaaaaaattttcttctttctactattcaagaacataatttattttggttataaaacatgaaatgtccctcctccttgtctcccaaactccctactgaagtattattatcagactagtatacgatctgtacaaatagcctttgatgaggaaaaaatggtacaaataaggtaagcaactaataggacaatacatatatatgatgtgctgtgtgtaaagtaaaagaacaagaaggaggaggaggaggaaggggaaggagagggaagaggagggcaggaggagaaaaagaagaaaacataataatgttagcaaacagcatacacatttccctgaaaaaaggcaaaaataaaacagaaacaaaaagtctattaatggaagttgcattgagggacaaggaggtaagaagaaagggagggctttgctttcaagtttgtatttctgtatttctaagttcctctgattacacagaactgtattatttgtgtcaattaaggaaaaaatgccaaggcaaaactaatctatgctgcgagaagttcagctcaagattgcccttggatgtgggtcatgcctagaagaagtctccaccaaggagacttggaggagggttgatgatgttttctcttgatctgggagcttgtaccagcaacaaaggtgtgtttagtgtgtgaaaattcatcaagctctatgcttttgatttgtacatatttctgcacgtgttaagctgggaaaaaagttccaaaagtgatgccaagagaaattattgggcagtaagattatagaccatttgttttccctttccctgtattaaattaacacatcttgtaaagataaataaaaacagaataaactccatattttttttctccaaatgtgtgtttcaaatacgtctgtttttacattgttgtagtcaacggagttagaaaaactaaataacatctgtgccaaaggtttcctttgcaagagcagaaggaggtctcctcctaggaagcctgggatccagctttggtggcttagcctggtctcagatgcccttgcaggaagatacctcaggccccggctgggctcagtgcccacatgcccaagctttcgataccaatgcaaaagcttctgtgctctttaatgggaggctattcagcagccagcaggcccagcatctacattctgaatcagacaaattcttctctccctctctggcaaggggacctcaattgctccctgtctgcaggaatccaccagttcagattaactgtttaccagcgaacatttgatgggctggcagataccttggtagataagtattcaaatgactatgcctgtcattacctttattcggaggagccacagtatccccctgcaggttgtgaacaagggccctgtatttctcatcagcttctgataaggttgcgggatcactgaagacccaggtagggttacaaggcaaccgtcgtgcttgacaaatagcacgctcccactagattttttgcattcacaaaattatcagttgtgctaaatgcatagatgagaactttaatctcgtttcacttagatggcagataaagtttgtgtgaaaccagtaagggctttttctgtcacctcaaagaaaggggtattaggggctaagggctttgcttttgtaattttccattatgttatccttttctttcaaaaaccagctgaatcaagaacacatgattacattatcatgtgtccttattgatgtcaatgagcattccacagtgggtttaaagatttacatatctgaaaacctggggtagaaaaggaaaaaaaaaaaagaagctagaatttaaaaagaataatgatctatttcctgggatggtttcctaattttctcttgaaaaccacgtggaaaattgactttattttaataacagaaaggagtcatagtagagactataacaatagtaattatagcagctgtcatttattgaacacctactatgctccatgtgttaagttctactttagtatgtgttagttcaatttctaccatgtgtcgttcttactatacaagagagaaataagtcctgagacatttctttgcaatatcacacaggtcatatgtaagtagcagaagaagaatgcaacctcagatcttttttagtctgacacctgctttctttctctgtatgttatgttgatgtattgatatgtccgttgcacttgcagataaacaatttggggctaacaatgggcttatcagctacacacttttggtaaatataaggactgactacttcacagccaactgtaggaggttaacaacctaggagacagagtctagctctagttcaaggagtcttgatcaatcttggttgttagttaagtcattctagattctcatgggcacaaagagactgaaaaatggattctaacagtctgatgatggtctttgtgatgatggcggtggggctgttttatagaatacaaatctactagctaagatgggaagagctggctcaagccatatcagagaggttagggaaaccgtatgaggagagaattccacctttagagggactggggagatggtgattttggtgggaacctacctaaatatccaatctaaaagcacacaatcccaggacaaactatttatgttctccaagggactaaatttattcattttatacatttagagagacagagatctaaagtgaacagaagtgtgttaatctagaaatggtgtatttttagggttgtggtcatttttgatacaggctggctatttatgaaaaggtgaaatgggaaaacaaatactcattccacttaatcaattcttggggaatgggacttgtgtgtgtacatattttaccgtattttcatctttgcttagcttggcatccaacacagcagcgggacagattttgaattcaagtagtaatgtagtcccataagttgccacaggaatactgctgtccacagaaagatgacagttttgaacactggattccccaaatgcaagaggtcatatgaggtggactttacaaagtttacataacaaagagcaattctgttaactaaaatgattaattcccgtcagtacacatcaaacagaactgttacaaaacattattgtctgagttcccattgcatagtaagggtttttcacaagttctatttccaataactcttttgacaaagccagagcttttttttttttttttctttttgagggggtggaggtagcagacattaatttccagaggaatctatgaatggggactgagtaggctgccgtcttaaatgtgagatatgttgcactgatgttgtggcaggaaaaagacaacagcccttctgaggaatggggccttccagggatccgggatggatgaaaaatgccctggcagtacaaaggctgattgtccttctcttcagagacaatggggtatttaaaaggctcacagcatcaaaatgctaacttagtcctttaagacattttcagttttatgtctcaccactgacagtaagcatgagtagaaaaagccctttttttgtgaaatctcttgcaaagaagtaggcagctttattgtgaagacactatttgcctgcaagtatagttaccttgaaaggtctcacaatcaaatgagcctgttttctgcttcttagaaagtagcagcaagaatacaaaaaaaagcagtgaactttcaaattcagaaggtctggacttgagggctgattctgccagttatttgggtgactgtgagcctgacatctagaatttccttatttgtaaagaataataactgccctcaagccagtttctcagggttgctgtgaaaattcaaagtaacaacgtacgccgagatggtttactgtgaagagtttcagaaatacaaatgaccaatatcaggaatgttcctatatggcctattctttcccttagaagttttgaacagagtttcaacacgtaagttaggacctttttcctttgaataattcccttctcaggctacggagtctcttcagtttcctggtcattgggttaaattttctgctccaatgaaactgcaataataggaataacagtgagttttaggttgggagacctgtaaattctaaccagatccttaaactgttctcattttccaaagctagtatattgcacaccaatatactttctttttatttcctctttggccaaaaagtgaattgtcaagtgcaagtgaattgtcaacattagtgtaactttctacacaaaaatgacctgcaccgtcttagcacctagggtctaaggcctcagttacaaaaataaattgtaaagccagaagaaaatatgtcacaataacaattagaggccaggcacggtggctcacacctgtaatcccagcactttgggaagccgaggtgggaggatcacctgaggttgggagttcgagaccagcctgaccaacatggagaaaccccatctctactaaaaatacaaaaattagctgtgcatagtggcacatgcctgtaatcccagctacttgggagactcaggcaggagaatcacttgaacccgggatgcggaggttgcagtgagccgagattgagccattgtactccagcctgggcaataagagtgaaattccgtgtcaaacaaaacaaaatggaacaaaacaattagaagctgcacagttttctttaggtggcaaaatatgtatgaacagttacatggcaagcaaactgcacattaaatttgggtgtattttccatatatgttgtgttctttacatttacagagctttgggggagggggacaaacagttatttatgagttttccacgaattgttttcttttctctttcactttctttggtcagtcatttgtaagaatcaactggagataacacgccagaccccaaacttatttttggcagaaatgcaccatccttgcatggacactagatggaaaaatagagttttctatttagatttctagaatgggttatagcaggtacctgggaaaggttacgcaaattgttcaacattcttgctgaagtggaaatgttcttggggagtccccgtggtcagcattaggaagaggaattacccgcagggcccaaaagacagatcctcccctttctaagaaggattgcagacatttgaattgagctttctcgggaggtttacgcagcacactcccaatgttcagaacagggagtaaagaaaacattttgcttgagaagcttccagacccctggggtgacttgtaggataagagtttggttgggatcctaaaaggtggtagatgttcagctcacacggactaagtgttacagggctggcttccagcttgggtaatggctgaacctgtgaatgttgcaagttggcttcatgaggtgccctaaaagtccagactatagactccacctgactcgccaggtcaatgctcccccttgtggtgatttctggagctgttatcagctgtctcctaggtggcccttagacaagtaagggtgcttgaaaacacatggtctgggaatgcatattggtgcctctcaaactcaagaaaggggtggcgacattccagttatgtgtctgttccaaagaccgcatatggccttctctaatttttagggttttttgagaaaaagttcacactagctgcttttaaattctcttgcctctgaaatccttacctgaacatctcccacctagaaaatatttttcactggcgacatctcttgttttgggtgagcagagatgaaatgacgcatggcctgtgtgattacggtgtgatgtctgcaccaggtgtaatgtgggctgaacagcttgacgtgttttcgtgaaaccaaagtataaccttcccaaattaacctctttgtttctgttaatgcagtcttacctaccaaagtattttaaatggttcttatgtatagtttaaaagactataggttatagctatgcagggggcacctatcttatgggtatttaacaacagaagcagcttcctttaaaagtggaatcagttatgaaatatatcatttatggggccaactcctccaagtactcattctgtttgcctttaagcaatatcttccagtatttgtaacagttgttctcagcagcacaaagaccttagcagttgagagataaagcatgagtttggtctgtgaccttgattacaacatgttgtgatgtgacgatatggctttgccttgactgacatttgtttggccactgccatgggtactgtttcaagtcagaagaaatttacatggagaaaaacatcccatgagcttaagttaatacattgggaacttgccctaaaactaggtggcttttttttttttttttttttttttttttggaaatcaaatagtaacaagtcctatgtaacaaacatctagtatcagggttactaggtgtattatacgtttatttaaatcaagatcattactaagcacctactatgtgcaggacaagtgtaagtgccttagtaaacattgttttttatgctatacaccattttaaaagttccaatcaatatttgctttccattcattaaacattgaaagttctttcagcatgccatctaatcacacgtaagtatttgcctttttccaggcttaacaaaacattttagacacagactatcaaagagcgaggactgtacaaatgtctccttctgataatagaactcggtggcgacttcagtggcccaggtcctgggaaagtttccacggcctccctggtgccctccttcccacatgactgcaggaacatgaagtagttctaaagacggagaccaaggtgaccggccttgcccctccaacacaagtccctcaagaatctttgtgccagggacatgaggtgggggctttatgttcctctactctccactgtctcctaggccaatccctttgtattacagatgaggaaattgaggccccaagagaagtgacttgtgtaaggtcacactgctagtacatcactgtgccagtcccagagccgtggacctgggactcccatctctatgttattttcttttcattaatctaaatcatcttaatctttcagatttctggatgaactagaaatcctttctcgcctctgagctttagtttacaaaccgtttcctctatgtgcaattccaccatcttatatcacccttgtaccttcacctttgacaagtgactggattactcttaagatcctggttaaaaaatcacttattctaagatgcccttcctgaccctccaagactgggttaggtgctcttccagtgcattatcctgtcattctctactgatgccaatcccagcatttgttacctgtggtgcagtcatcgagatctccagcacactgcaggctcattgcggacaggaacatatgtcatgtcatggttgcatccctgatgtttagcacagtgtctgggactcactaaataaatagtgaatggataaatggattactggacaagtattctgtcttaaaaaaatgagagttaaagaagacccagtttgcgcaggtggagaactggtagaagaggggatgggggagccaggtgtggcagcatgtgcccgtaattccagcaactcaggaagctgacgtgggaggatcgcttgagaccaggagttcaaggttacagtgaaccataatcatgccactgcagtcaagcctgggcggcagagtgagactagtctcttaaaaaaaaaaaaaagctggtggagtgggtctgtgatgcctagaccccaactgaccctctctgtgtgcttatcctcctgtgaaccttacgatgtctgttcttcaaattcgtatgattttgaatttctgcagaggcctgcaacaaagccatgagtagtttagtacggaaatgcttaagagaaccccccacacaatttctctctgggtctgctggaggactcttcccagaataggccgagcaagggccttccgttttttttttgtttttttctttttagatggaatctcactctgttgcccaggctggagtgtggtggcacgatcttggctcactgcaacctcccatgttcaagtgattctcctgcctcagcctccccagtagctaggattacaggcatgtgccaccatgcctggctaatttttataattttagtagagacagggtttcaccatgttggccaggctggtctcaaactcctgacctcaagtgatctgcccacctaggcctcccgaagtgctgaaattataggcgtgagccactgtgcctggcccaagcaggggcctttttgaagattcccctgggatcagggaggagttggactttttatctgcaagtgtgattagctgaagtcttttttaccccttgcagatggctgccaagggtttgtttcacgccaactcactgccacggtgcggctcacatgggaaaggaaagagaagtatattcttgtgctaacataacccaggggcccaggggcccagaggcttctaatagtggacagcttagtgtgttaccagaggcattgacttcccaggacacctcttggggccaattgactggcactgcagtcacaagcagcttttctagcagaactctggacttagggttgaagggtggtgtttcccactatgcctggagtaggtgccttgctctggagatcaatgactgtgggcttagatatctccagggcaacaaggctctttccccagtcatggactttgtattaatcgcattggctgctctatatgctgcacagtggtctaccaccaggctcagagcccagcttgaaatgtcagggccatggcaggattcactgaaatagaaccatcacttaatactatggttttgaggaaaaagcaattattccttcccctaactaaatgaccttccatccttccttttttgcatcagtttcctcatctgtaaaataacagatttgaatgaaatcaccttcaaagtccatcttacaactgagattattcaatttttataaccagagtctgtagttcctctctcagaacatttattctaaaacgctagtttcccaatccacatagacatgcccaagatatcccaaaggaggaggtccttaaagcccaaacttactggctatcaaggtcttgtcatcctaaagtcaacttcttattttgcaatgaaacaacccaatccctgacccctacctgtgcctgtgcacatacaagatgtccaccttcccacagagtcctccccacaagtatctgtgggaacaagtttaccccatggtatctgagaggcttcaagcaccagtctttgctctactgagcagggagctctttgcaggtggtggctgcccggcctccaggcactataaagaacttggtctgtttctcaaggaaggaagcactccttctgatgtgtcaaaaactgcagctccctgccgagagagccacattgagctctccatgcacaaaaattgtgcatgagcctgggggaaggagaaaagaatgactttttcatttttgtgatgctctgttaaaggggcctgatatggtttggctgtgcccctacccaaatctcatcttgaattgttactcccataattcccacatattgtgggagggacctagtgggagataattgaatcgtgggggctaattccatactgataattgaatcggtatggaacctcccatactgttctcagggtagtgaataagtctcacgagatctgatggttttataaggggaatccccttttgcttgtctctcattctctcgtttgctgccatgtaagacgtgcctttcaccttccaccatgattgtgaggcctccccaaccgcatggaactgtgagtattctaaacctccttttcttcataaattgcccagtcttgggtatgtctttatcagcagcatgaaaatgaactaatacaaggccccaaacagggattcacaactaatttgacctaaaatgcagggaaatggcacttccagtgtttaccagagtccctctctcttgaacctaaacatgtcctcagagggctcctctggagatgagtccctggagtaatggtcaacaagctttccctggaatcttttcagtcctctgattactaggtttattatttagtttattgtgccacttatctttttattttgaggggagtcctcttggaggaagcaaaaaagcccagaatcagagaaaatgtggagctccttcatcagtttgccagacatgccccagcatatttgggtggacatgggcatgacataggttcaagagagagcctggctgcataaagacctttgcactcttggcagcccagtggtcatttctccaatctggactttatttctcctttatcctgttctaataaatcactgaatttgcttagtgattttcctttagtgatggatggaacaagaaccagttttattcatttgactgcaagcattggttttgtacactcactcagtactctaggggccttcagacaggatcttaaggacaccacccccaccctaaggcaacaagagctgtggaagtggaaggagtgtatggaagatggccacaagtttcaggaggtttgcccatcctaagggaataggtatgattttgatgggtcagccccagagatgctccagagcagcagtccccagcttttttggcacaagggacaggttttgtggaaggcaattttttctacggattgaagtcagggggcatggtttcaggataaactgttccacctcagatcatcagccattagttagagtctcgtaaggagcacgcaacctagatccctcgcatgcacagttcacaatagggtttgtgctcctatgagaatctactgctgctgcaaatctgacaggaggtggagctcaggtggtaatgctcgctcaactgctgctcacctcctgctgggcagcccagttccagttcctaacaggccacagaccggtactggtccatagccaggggtgtggggagagcgggggggttagggatccctgctctagattaagagtctttctgcttaattcattatttcaacaaatattcatccaatgtccactgtatgccaattacaggctacattactgttctaggcatcagggatagtggtgaacaagatgtgctgacaaaaactggaaatccaatgggctatgggtagggggaagttcttgctgttggaccccagagctagacagatcatttaagaagtattaaactgcaaagttgaaagactacccacgtgtagtatttcacaactcagctattccagaactgctaatacagggccttggaacgtatggccctaggtgaccacattgaccacatgtaatttggagcttattagacagaaatctctgatttctgagagaaatgagatacatcctttaggaagggagcctaggaaatcacctttttgggagtccttaaagaggtctagatatcagcctagagccacaatgctgacaccttgtcctgcttgtgccaggctgtgtcattggtaaacagggcacaggcttccagcctgctttctggcagtgggaatgtgggtgctttggaggttcctgccactaatgaccagtggcctggatttaaaagatgagggggaagggtaaagtctctgcctgtggaacaggatttatccaactgacacgtacagaaatgaaatttaaccccacagccctgactcaacagacacattcagagctgcttaccgcaacctcaaagtacccttgctctgtagaaatgttcacaaagtgatataagcaatttaaaataaggggggtttggggacaaataagcttgaaaaatgcttgcctgatcaaaattcaccaagttgctttactgtgggactttacagagatgatcatgtgaacaggtacttttgtgaagcactgtggtggtggacaggagagagagtttggcacaatttgcaaacatatttgggcacaaggacccttccctagaggtgcaccccttggggccagtgttcttggaaactgctttggaaagcattggtttaggatgaggttgtcaccagacttgagctgtcattcagcgaaattaagggtgatagttgccctttctctttttactaagacttgcattttaactggagtcactgattttttttagcattttaatctttttaaaactaccacactgctcatgagagaaaatgccttaagtcaaacaaaagaaaataaaaaacaaataacaacaactaacaacaatccccttagtctcttaaatttcaaaaatacacgttcttatcaggcttaataagggtcgccaaaaaaaacttacttttgggtaatgtacttgttattttttcttttaaaaagtatttactatttgcactgtagggaatttaatttttagagttagctaaagttctctatatagccatctaaatttatagctatttattactatctatctatctacagtgtttatatggtctagacggtaaagtatataactctaagaaagaattaacaataacaaattctgagcctctaacaaagaaattcagaaaggacctactcaccttattaaaaaataaatctacttttctccccgtgtgaattcaggctctgctacttattaattatgtgactttgagcatattataccagctgtctctgagctttagtttcttcatctgtgaaacgggtttgttgagaagattgaaagagatgatgtatgcaaaagaattaacaaggcacacggagacatgaaatggtaaaaaccaaaacggcattttttaaaggaggaaatgtagtacaaatttatctatttaaaacatttaaaattatatttaaattataactattaatatattattaaatatttggtgggcttgcagcaattccaagatgacgtttcctgggccccaatcccagagattctgattcagaaggcctgggaccctgcgtctttaacaagcttccccagttattcagctgtgtgggctatactttgagagaaactaggttggaggtgaagaaataatagcaggtaatgggaaacatctgactagagctttagatctggtgcacttgactacatgcagatttaaagtagccaatgtaattttgaaaaaacatttaaaaaccatgctttattataaaatgtttccaggcagcttgggccataacggccattactgaataagtggatgtggtgggtgaaacagtccaactgtgactttctctattattctcctttgatgacagaaaatatatttctcatgtcacacatttatctgcttggggaggaaaagagattggtcaatatttgcaatttcagggacattttgcatctgctttatgtgttgagttttatgatatataatgttataaaacattttattccataaacacagttaacaaggcagattagattggcccttctgacagattagataggctttttttttagcctttgaggaaatgcagcaagagcacaggggacacagttgttaaaatgtcatctgaataaaaggttccgggactagcctccaactccaccagcagccatgaggaagtgaaggagtcctcggggcgtttccagagaatttctacctatgaacaggtgttactcctttgcaccatgacagagaaacagcagtcccttttctcccagaataaagatggtcattcctgccttgtgcaaaggtgacataccattaaccaaaaaaaggagttacttttgtgaactctgagattattcaccgcccagagtgaatcctaggtttccttaattaaaaaacaaaaaaagttctaaaatgagctcctttctattcagctatacacctttgcttttctcaccacctaaaactggagttcttaaattttgagagaactgtaccattatgtatgagtgaatttgtatgttttccgaatatttgtctatttgatcagtgagaggagaaagggacatcatgtcttgtgtggctgatgctgtttccctggtatttggtgcaaaatataaacccaaattaatctcataacagccagttttctagatgaggaaattgagacatagagaggttaagtaacctgctctgggtcacatagctaataaatgacaaaagtgcattcaaacccaggtggtgaggctgcagaatcaatcttaaccactgttctatattccttcttaccatattaatattactaacataccaagattcatagggtttcagagagattgcactggatgtgtgagagtataagaatcaaggtttaagaggagtgaataatagttaaatcaaattatttataattggatgtccttcaacttccagcatgcctctccctttttctccttcaatattaagtcttgggttctaattgcttcctggaaggggaagtgatagtgcagacaactaataacaaaataatgatagcaaaatagtaatggtaacagtaactgctaacatgtattgtgtatttactgtttgaatgcctccctgcagactgcacactgagcattttgcatatatcatctcctttaatcttccccacaagcccatttcacagatgaagaaactaaaggtcagaggcacctggtgtatgtaatatgctcaaagtcacatcgctaataagaagtgaaacctgaattcacctagggggaaaaattggtttattttctaataaggtgagtaggtcctttcttaatttcttttttagggactcagaatttatatttagaacagggacagcttgtttttcagcttgtcgcttgattcagtgtgttcatactttgtgccatccaccaaatattctcaggtttttaccttctgagcacttagaaagattacataattccctcctccttcccccttctgcccacccttgtgactaggagatcaggcaacaagtggtgagaaatggttttgcgtgttgcttctggccagggctggatacttctaagcttgctttccctgggcaacatttcagatgggaactgtcctctcagcctcagcctagagaacacttggccccattgcagagggagaattgtgtgagtgagaaggaaaccctggcatgttttatctgggatcattatagatttccagaaagttgcaaaaatagtatgcagtgttccaggaacccttcatccagcttcccccagtggtgacatggtatatggctgtagtacgatatcaaccaggaaactgacattagtatagcactattagctaaagactttatgcaattttttccagttttaccaggagtcctttgtgtgggggggggagtgggggagagggaggtactatgtgatttgatcccatgtacagcttaaccctgtcattgtaagattttgatgttattatcacagcagagattccctaccctgcctgatccacccaacctcttccacatttaggtgtgatcttaaaggccacctgactcctggaaagtcatattttggccagaaattactgattaaagtgtttcttctggtcatttgggagatcagaagtgattccgggatggtaggaggggttgggggaaacatgtatactttttcctttgcttttaggtatttaggaaacaatttatgttacttgaattggtttgggaaaatgaggcctctcgagaagtgaatgcctgggaaattcagtgtttaacagacctgataataatgtgagaagaagggtggcgacagaagcatagatgggcttattatgtggaaggcgagaaaaaaaaaagattttaatgccaacactccccacatgacgtgaatgaacatgccaattcgagactccatttctcgttctcatctacacagcctggcaaaatattctgaaagcataagcgaggaaatatttgtgctgccacaacattaccactttccttctctagtactgtaattttggtggcaattcttcaaatgaccaatctacttggaaaattacttttttttcttttgccttagagaactgtcatctcagattattttgatcaacactttagcagtaatctcaggacatggaaacaaccaatttgcagataatgtcatacagaatttaagtctgaacaagcagaaaaaattggttaagagtctgaagccatatttaaatctccattcatcgactggctgcattgattgaattatttaaccattgttttatacatacttttaattgaaattttttctggctataattgaaggttcacatttaggcataagaaataatagagagagactgattctgtatccctgttacccagtttcccccaatgctgacattttgcagaactatagtgtaattttacaaccacgcaattgacatagatataatccaccaatcatattcagattttcccagttttacttggactcatttgtgctgctgtgtttgtatttagttctatataatttttcacattgcaggttcatatattcgccacaacaatcaaggcagagaacatttccatcaccacaaggatccccaatgttgactttttacaaccacatccaactccctccctctctttgtcctcctcccatggtttcttatctccctagcaaccactaatctgttctcggtttctaaaatttttatcatttcataaatgttctataaatggaggcaccagtgtgtaatcttttgggctttttttttttttttcacttagcatgactccctggagactcatccaagttgttgcaatattgatagtctgttcttctttactactaagtagtattccctggtgtattaatccattcttgcactgctataaagaaatatctgagactggggaattaataaagaaaaggggtttaattggttcatgattccacaggctgtccaggaagcatgattctggcatctgctcagcttctggggaagcctcaggaaacttacagtcatggtggaaggcgaaaggggagccagaatgtctcatggctgcagcagaaagagggagagtggggagatgctacacgcttttaaacaaccagatctctctcggtctcactcactcactatcgtgacaacagcaccaaggagatgatgctaacccattcgtgtaggatcacccccatgatccaattgcctcccaccaggtcccacctccaacactggggattacaatttgatatgagatttgggtggggacacagacccaagccatatcacctggtatggatgcaccacagcttgtttaactatccacttggtgaaggacatctgggttgtttccagtttgagactgtatcaataaagctgctatgtcggttcctgtttaggttttcacgcggatataagtttttatttctctagaataaatacttaaaagtatgattgctgggctttctggtaactatatttagttaatgagaaactgccaaacagtttaccagagtaagggcaccacgttacattgtcattagcaatatttgagtgatccagtttttcctcatgctccctagcatttggtgctgttgctctttttgttttagctattccgacaggtgggtagtgataactcattaactcgcatttctctgatggctaatgagcttggacatgttttcatattctgtctgtacatccttttcgtgaaaatgtctatttctgtgttttattcattttctaattggattgtttttttttcctgttgagttttgagagctcctcatatatttatttgcctcccaatctatagcttgtcttcccacacactttaactaggctttctctcaggaaacatttgccttatagtttaaaggtatgtttctgaggcattaaaataactatgttcattttttcttagtaatttaacttttttttttttttttttgagatggagtttcgctcttgttgcccaggctggagtgcaatggcgcgatctcggctcactgaaacctccgcctcctgggttcaagtgattcttctgcctcagctttctgagtaactgggattacaggcatgcgccaccatgcctggctagttttttgtacttttagtagagatgaggtttctccatgttggtcaggctggtcttgaactactgacctcaggtgatctgcctgcctcggcctcccaaagtgctgggattacaggcgtgagccaccgcgcccagcctattttttttttttttttttttttttttaagataggatctaaccctgttgcccaggcttgagtacagtggtgtaatcacagctcacagcagccttgaacttttgggctcaagcaatcctcctaccaaagtctcctgagtagctgagactacaggtatgcaccaccatgcctggctaatacttttgtattttgctgtagagatggggtttcaccatgtcgcccaggctggtttcaaactggtgggctcaagcaatctgcctgcctcagccttccaaagtgctgggattaaacttgtgagccaccacacctggctagtaatttaacatttattgccttttaaagtgctttttgtttctctttcagatctgtaaatatagaatgaagagtttttttttcctcttaggagattattagggacatagtttcataagagaatgagaaattactttgtgtgaatttaacatgctgtctcagcatcagcagagttaacaatgaagactctttagtacagaaaaagaagatggacagaatttcagcagagaaaatatgctagtgtctaagactttggtagatatagtctgtgtaaagggaagaaaatggggcatttgaagagagaagaatctggtagccttaaacaactggtaaagttctggttatctggaagctgaggaactgagggccccgggtccgtcccagccactacctgggaaggaaaactggttcaaacgaagcagtgacagaagccagtctctgctgaagcatttaaactgctctggattttacagtgtacatttgcagagagtttatttaacctgtctggctttgcatttcaattttccatcttctaatttaggcttaagattcttaaaataggcctggcatggtggttcacgcctgtaatcccagcactttgggaggccaaggtgggtggatcatgaggtcaagatatcgagaccatcctggccaacatggtgaaaccctgtctctactaaaaatacaaaaattagctgtatgtgatggcgcacgcctgtagtcccagctacttggaggctgaggcaggagaatcgcttgaacccaggaggcggaggttgcagtgagcaaagatggcaccactgcactccagcctggcgacagaatgagactctgtctcaaaaaaaaaaaaaaaaaaaaaaaaagattcttaacctatgttgtattagactaaatgctgaaaaaaacatccaatttgtgatataatacttcccatatactctatgaaaatgtaaacacatatacatttatatactgtgtatctaaatgattttattacctctaaactgtattaataatgaaagttgcatgatatttgtgaaggttattctaacataattttctcactatttaaaagactcaaagagattatgttatctttcttctcctcactttctgtattttccattctttctcaatgtgaagactgacctctagtgttctgttcttttaagaattaatagactaagtctagtagtgattagatatctgtatacaaattgtttcaaagatcagttctacaaatatttgttacgtatctaccaagtgctacaacctggtgattaagatcttcctcattctacgactgcctcaaaccatgctccttcttttgaaggacctctgttgggtatgcattacatattacggaactaagacaatatcacggaactaaggaggtaaaataaggggtggcacatcactaagttaaatcaagagacagagaaaaacatgcacgatcctgtttatatacatccatgtgttgcttaatgatgggggtatgttctgaggtatgcattctgaaatgcatcattaggtcattttgtcattgtgcaaacatcacagagtgtatttacacaaacctagatggtctactacacacctaagctatgtagtatagcctattgctcctaggctacagacctgtacagcatataacagtcctgaatactagaggcaattgtaatacaatagtatttgtgtatctagacatacctaaatgtagaaaaggtacagtaaaaatgcagtataaaagataaacaatgatacagctctataaggcacttatcatgaatggagcttgcaggattacaagttgccctgggtgaggggaacatcacacactagggcctgtcggggagtgtgggggctaggggagggatcgcattagaagaaatacctaatgtagatgacgggttgatggatgcagcaaaccatcatggcatgtgtgcacctatgtaacaaacctgcatgttctgcacatgtatcccagaacttaaagtataattttttaaaaattgagaaaaaaaaaaaagaagttgccctgggtgagtcagtgagttgtgagtgaatgcgaaggcttaggacattactgcacactactgtagactttacaagcactgtacacttaggttactctagatttattaaaaatattttttctttcttcaacagtaaattgatcttagttttctagatgaccatttctgtatatgtgctctgttgctaactgaaacatcatcatacggctcatgactgtatttaaaatggttatttcctgaaatgtttgctcttatgaaccactgcattcagagattgatccccacaaaaaggctttcagaagtataatttctaaaacatgccaagcctttaatgttatggattgcagtttttcatgagaatgacctaatgagttttaaaaacattttattggagaaaatttcaaacattcacaaaagtagatagaccgacatacctatctactttggagaatgtttgaaagacatatgggaagatggcgagagggaagaaggaagagagagaggaagtgaggacttaaagaatgagaaggaaaaaatagtcacctcctccaagaaggtgtccttcatgtttgaaattaaccatcctttcctcagcaggctttctattatttcattgttatttctttctgcctcatttaaaataaaatgttacaaatgtccgtttctgcctgttgaggggtggaatatgtctttctccccttgtgttatttctcaaggagcaccctgaggtgatcctgttaaaacctcacttggatcacactactcctttgtccaaaccccatgaaggttttccacttagagtgaagctgaagtcctcacaatggcttcaaacatgccggtattctctgccctggggcctttgcacaggttttttgccctgtcaggaacatttccgccacccaaatatccacttagctagttcactcacctttttcaagtttttgctcaaatattaccttctatttccctactccagcacttcctaccctttttgttttttgtttgtttttgttttgttttgttttgagacagagtcttgctctgttgcccaggctggagtgaggtggtgcaatcttggctcactgcaagctccgcctcctgggttcacgcctttctcctgcctcagcctcccaagtagctgggactacaggctcctgccaccacgccccactaattctgttttcatatttttagtagagacggggtttcaccgtattagccaggatggtctcaatctcctgacctcatgattcgcccacctcggcctcccaaagtgctgggatttcatgcgtgagcgaccgcacccggccccctttctttacttgacttaatttttctccaaagcaagtatcatcagaagtttccatgagccgcattgaacgtaagctccaagtgcagactgtgtctccagtgcttggcttggtgagggtgtgtcacacagccgatgctgcagaagcatctctgagatgaatattgaatgaactgtgtctcacagagtggatttaatatagttggcacacttgatgaatgtttgtggaatgagccaatgaataaattctgacccaaacttgctctaagtaaccaaactgcctgtgaaagcaggggaggccaattgaaactaaactgtagaatgcagagccaggtagtggctccatcaactttgaaaaaggtgtctgtgaacccagagtatgagttgtgagaaatcaagtgaaatgttcctcctacttctgtttcagaatccacttctaattctgaaagtcacattctacgattttccttaaatatctggctctggtacaaatcctttgaaaaaaaatagttagcaatcctcatcacccctaaactgttataccctaagctgggtatttcaaagcaggcttctcacttacattaatacaagatttctgttcctcctgttaagtgacagtgtacatcctttgcaaaaaaaaaaaaaaaaaaaaaattttttttttgcttttggtcaccctgtagcaatttccttgggaacaaaataacaagtgtagaaatatcaagggaaaagcacaaaggcccttcttcagtgggtggtcaatatcactttaattcttcattgtaatcctcacaaacacacagccctgcgaactattaaattactatggggatttcttctgggctcctcgccccagctggtctcaggatgttctcggcaacaggcagcttgggtaatgttctccaaacacctgtcacctgctccatacaataatctaaatagaatgtgaatacaaaaggcctattaacaattatgcaatgatcagtttggctcaggcggcatgtctgtgtggcctccttgagaacgtgttgaacattcccttagcaggcacatcaaaacacatgagacaagaaagggcatgaggagatggttgctaactcactactcccaggctcagccaaatgagtctgcgcatatggaggtgatcagtgggtagagacagacatttgtgtgaggctaaaggcaggggatctggcgaagcctatgtgagccaagctctgaaacttatgtatctgtgtgtgtgcacgtgtgcgcacatgcatgcacacatttagtgagtagttctttctcctttgttgttatacaaatgacattcaaactcttggtgtttgaacccaggcttcttatcttccccaccatctttacttaatgcatgacaggtccagggtaaccaactgtccccattgcacaggactgagggaacacgggactctcagtgctcgatgtgagaaagtctcaggcatactggtacacgctggtcaccttatgtcctaagttcttagtctacgtttgcatgacacctatattcaactcaccagtatatacacaacagactgatgattccaagggggaccaacctacaccagcaattctaaataaagtcactgaaaaaatacccctcctggctggggcagataacccccatcacagcctgcccttagtatgcaactgtgtggagcagagactagtctattaactggaaatgtcttctttattgagggcttcttatggttatgctaagccctttacacaattttctcatttaatctactcactaatttataaggaaggcactcttagttttccctatttgtagatgagtgactaagaagtaaagatgtctctcgcttaaggccacatagatagtacatgtgcaatctgaatctcaggcctgtttgaggccaaagataatgttcttagcctcggtgctctgttgcctttgtatctagttcctccaggaaaaccaggctgaaagctgactctgtgaccattcagatccatgtggtgggctcggagatggctctggtgattcagaagggctgcttaaaaaaatatgtgtttaatcaatgaaggaacgagtaaatacactggcgggaactctggtagcttaatagtttccagttagcttcatgtttaaaacaagacaaatcttttttatttttccatcaattgggagttagttgccttcaagtcctaaggatttccaaaatggaggtctgacctagttactgtccctgtcactctcctctttgggggacatgctgacatcagcagacactcactgttggggattacctggaccaggaagcactaatgtctttgcaagattcttctaagactagctgatttcaggaggtcccaggactgagatagcttctgaaggtttgctgtaggcagtgaggtcaatattaatgcagttcccaaatctggcctcatgtgtaacaagattgatgctccctgcttttccctaggacagtctaatttgaagacttttccgtgatttcaggggaaggttccaaaataaaggatgcatgctgatgttctgcggcctacgtttggttagtaaatatattttgtttgacctgcactgtgttccaaattttttttagttatttgatacttgaaagaatagggaaaccttgcatgaaaacatgcatttctagctgcttctcaaacattagaaaactggacctatacctacctagcagcactggctgaggctaagaacagctgactcccttagacaagatgtgtgtgtgtaacttacacaagtcccacgggctctattatctactgaacacattgcatgtatttatgctacttgtcttctcttgtcatgcaccggagcttgtgattcttgctctagatttacgttgtccaatatggtagccactagctacatgtagctagttgcatttatatttaaattaattaaattcataaaatttaaaatgtagctcttcagttgcactagccacacttcaagtgctccttagccacatgtggttagtggctaccatattgggcaacccagattagaacatttccatcatcacagggagtctgttggacaatgctgctctagacattattctagaattaaggctggcatctagtatgaaattattcctacctccatatcacttaccacccactgaacagattttacattctgaaaatcttatggcaagagcagagggaggaggatgagacagaggagaaggaggaggaggagaaaccactcatagagtgctgactcgtgtcaagcactataataatataataacgacattccatgaattgtctcattgaattctttcaacagtcctatgagataagggagattataactcctccccattctaaagataaatggaggtttaagagttcactacatcgtactcaggaggctaaggcaggaggattgtttgaacccaggagtttgaggttatagtgagctataattatgccactgtactcaattatcaattctctgggtgatagagaaagaccttgtcttaaacaaacaaccaatagttcattacattgcagaaggtcacatcgttaatagacggtggagccagtttaaactgtctgaccctagaactcatgctcctaactcatgatctttcaataacagaaaatccacagaaatggacccccagtctccattagcagtgagcccactgaaagtcaaggggaagggattctgtgccctcagtccactgggatctggctgaaacttccaacaaattagtgcaattagctaaaagttatattcttggccaatcctaatgcccactttgattaaaaactgaaaactgtccattttaatgtcgataacttatttcttcatttctgttgtcattccattgcttctccttttctagaatttgagaattcatggctactaagtattagctgattgcaaatattgatacctatttcaaatatttattaagaaaggaatttactttgacattcaaatggaaatgacattttttttatcttgaacagagtttattattaaatgtgttgttccagaggagccaagatggccaaataggaacagctccggtctacagctcccagtgtgagcgacgcagaagatgggtgatttctgcatttccaactgaggtaccgggttcatctcactggggttgccagactgtggatgcaggacagtgggtgcagtgcaccgtgcgcaagccaaagcagggcgaggcatcgcctcacccgggaagcgcaaggggtcagggaattccctttcctagtcaaagaaatgagtgacagacaccacttggaaaatcgggtcactcccaccctaatactgcgctttcccaattggcttaaaaagcggcacaccaggagattacatccctcacctggctcagagggtcctacgcccactgaatctcattcgttgctagcacagcagtctgagatcaaactgcaaggtggcagcgaggctgggggaggggcgcctgccattgcccagacttgattaggtaaacaaagctgccgggaagctcaaactgggtggagcccaccacagctcaaggaggcctgcttgcctctgtaggctccacctctgggggcaggacacagacaaacaaaaaggcagcagtaaactctgcagacttaaatgtccctgtctgacagctttgaagagagtagtggttctcccagcatgcagcttgagatctgagaatgggcagactgcctcctcaagtgggtccctgacccccgagtagcctaactgggaggcaacccccagtaggggcggaatgacacctcacacggccgggtactcctctgagacaaaacttccagaggaacgatcaggcagcagcatttgcagttcaccaacgtccgctattctgtagccactgctgctgatacccaggcaaacagggtctggagtggacctctagcaaactccaacagacctgcagctgagggtcctgtttgttagaaggaaaactaacaaacgggaaggacatccacaccaaaaacccatctgtacatcaccatcatcaaagaccaaaggtagataaaaccacaaagatggggtaaaaacagagcagaaaaactggaaactctaaaaatcagagcacctctcctcctccaaaggaacgcagctcctcaccagcaatggaacaaagctggacggagaatgactttgaggagttgagagaagaaggcttcagacgatcaaactactctgagctacaggaggaagttcgaaccaatggcaaagaagttaaaaactttgaaaaaaaattagacgaatggataactagaataaccaatgcagagaagtccttaaaggacctgatggagctgaaaaccaaggcaagagaactaagtgacgaatgcggaagcctcagtagcctatgcgatcaactggaagaaagggtaacagtgatagaagacgaaatgaatgaaatgaagtgagaagagaagtttagagaaaaaagaataaaaagaacgaacaaagcctccaagaaacatgggactatgtgaaaagaccaaatctacatctgatttgtgtacctgaaagtgacagggagaatggaaccaagttggaaaacactctgcagcatattatccaggagaacttccccaacccagcaaggcaggccaactttcaaattcaggaaatacagagaacgccacaaagatactcctcgagaagaacaactccaagacacataattgtcagattcaccaaagttcagatgaaggaaaaaaatattaagggcagccagagagaaaggtcgggttacccacaaagggaagcccatcagactaacagctgatctctcggcagaaactctacaagccagaagagagtgggggccaatattcaacattgttaaagaaaagaattttcaacccagaatttcacatccagccaaactaagcttcataagtgaaggagaaataaaatcctttacagacaagcaaatgctgagagattttgtcaccaccaggcctgccctacaagacctcctgaaggaagcactaaacatgaaaaggaacaactggtaccagccactgcaaaaacatgccaaattgtaaagaccatcaaggctacgaagaaactgcatcaactaatgagcaaaatacccagctgacatcataatgacaggatcgaattcacagataacgatattaactttgaatgtaaatgggctaaatgctccaattaaaagacacagactggcaaattggatcaagagtgaagacccatccatgtgctgtattcaggaaacccatctcatgtgcagagacacacataggctcaaaataaagggatggaggaagatctaccaagcaaatggaaaacagaaaaaggcaggggttgcaatcctagtctctaatgaaacagactttaaaccaacaaagatcaaaagagacaaagaaggccattacataatggtaaagggatcaattcaacaagaagagctaactatcctaaatatatacgcacccaacacagaagcacccagattcataaagtaagtccttagtgacctacaaagagacttagactcccacacaataataatgggagactttaacaccccactgtcaacattagacaaatcaacgcgagagaaagttagcaaggatacccaggaattgaactcagctctggaccaagcggacctaatagacatctacagaactctccaccccaaatcaacagaatatacattcttttcagcaccacaccacacatattccaaaattgaccatatagttggaagtaaagcactcctcagcaaatatgaaagaacagaaataataacaaactgtctctcggaccacagtgcaatcaagctagaactcaggattaagaaactcactcaaaactgctcaactacgtgggaactgaacaacctgctcctgaatgactactgggtacataacaaaatgaaggcagaaataaagatgttctttgaaaccaacgagaacaaagacacaacataccagaatctctgggacacattcaaagcagtgtgtagagggaaatttatagcactaaatgcctacaagagaaagcaggaaagatctaaaattgacaccctaacatcacaattcaaagaactagaaaagcaagagcaaacacactcaaaagctagcagaaggcaagaaataactaagatcagagcagaactgaaggacatagagacacaaaaaacccttcaaaaaattaatgaatctaggagctggttttttgaaaagatcaacaagattgatagaccactagcaagactaataaagaagaaaagagagaagaatcaaataggggcaataaaaaatgataaaggggatatcaccaatgatcccacagaaatacaaactaccatcagagaatactataaacacctctacgcaaataaactagaaaatctagaagaaatggataaattcctcgacacatacatcctcccaagactaaaccaggaaaaagttgaatctctgaatagaccaataacaggctctgaaattgagtcaataatcaatagcttaccaaccaaaaaaagtccaggaccgatggattcacagcggaattctacctgaggtacaaggaggagctggtaccattccttctgaaactattccaatcaatagaaaaagagggaatccttcctaactcattttatgaggccagcatcatcctgataccaaagcctggcagagacacaacaaaaaaagagaattttagaccaatatccctgatgaacattgatgcaaaaatcctcaataaaatactggcaaactgaatccagcagcacatcaaaaagcttatccaccatgatcaagtgggcttcatccctgggatgcaaggatggttcaacatacgcaaatcaataaatgtaacccagcatataaacagaaccaaagacaaaaaccacatgattatctcaatagatgcagaaaaggcctttgacaaaattcaacaactcttcatgctaaaaactctcaataaattaggttttgatgggacgtatctcaaaataataagatctatctatgacaaacccacagccaatatcatactgaatgggaaaaaactggaagcattgcctttgaaaactggcacaagacagggatgccctgtctcaccactcctattcaacatagcgttgaaagttctagccagggcaatcaggcaggagaaggaaataaagggtattcaattaggaaaagaggaagtcaaattgtccctgtttgcagatgacatgattgtatatctagaaaaccccatcgtctcagcccaaaatctccttaagctgataaggaacttcagcaaagtctcaggatacaaaatcaatgtgcaaaaatcaaaatcattgttatacaccaaaaacagacaaacagagagccaaatcatgagtgaactcccattcacaattgcttcaaagagaatacctaggaatccagcttacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgcaatccccatcaagctaccaatgactttcttcacagaattggaaaaaactactttaaagttcatatggaacccaaaaagagcctgcatcgccaagtcaatcctaaggcaaaagaacaaagctggaggcatcacactagttgacttcaaactatactacaaggctacagtaaccaaaacagcatggtactggtacgaaaacagagatatagaccaatggaacagaacagggccctcagaaataatgctggatatctacaactctctgatctttgacaaacctgacaaaaacaagaaatggggaaaggattccctatttaataaatggtgctgggaaaactggctagccatatgtagaaagctgaaactggatcccttcctcacaccttatacaaaaattaattcaagatggattaaagacttaaatgttagacctaaaaccataaaatccctagaagaaaacctaggcaacaccattcaggacataggcatgggcaaggacttcatgtctaaaacaccaaaagcaatggcaacaatagccaaaattgacaaatgggatctaattaaactaaagagcttctgcacagcaaaagaaactaccatcagagtgaacaggcaacctacaaaatgggagaaaattttcacaacctactcatctgacaaagggctaatacccagaatctacaatgaactcaaacagatttacaagaaaaaaacaaacaaccccatcaaaaagtgggcgaagaacatgaacagacacttctcaaaagaagacatttatgcagccaaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactagaaataccatttgacccagccatccaattactgggtatatacccaaaggactataaatcgtgctgctataaagacacatgcacacgtatgtttattgtggcattattcataatagcaaagacttggaaccaacccaaatgtccaacaatgatagactggattaagaaaatgtggcacatatacaccatggaatactatgcagccacaaaaaatgatgagttcatgtcctttgtagggacatggatgaaattggaaatcatcattctcagtaaactatcgcaagaacaaaaaaccaaacacctcatgttctcactcataggtgggaattgaacaatgagaacacatggacacaggagggggaacatcacacactggggactgttgtggggtggggggaggggggagggatagcattaggagatatacctagtgctaaatgacgagttaatgggtgcagcacaccaacatggcacatgtatacatatgtaacaaacctgcacgttgtgcacatgtaccctaaaacttaaagtataataataataaaattaaaaacaaaaacaaaaaacaaaaaacaaacaaaaaaagtattgttccattcttatttagaagcatcatttttacaaatcattcttacataataacattatatgcccaggaaaaaaaaagataagtactttagcttatccctactatgtagtaataggaattacagatcactttgaaagggaggaatgtcagactaattaatttcattatgggtaagaattttgacattgtcgtcttgttcgtgggccaaacagtgagcaaggttcagatgcagaaacatgtttttgttgcttctttgtatatattttacaaattcttcctgataagtctcttttgtctgctttctctgtaacttttcactatttgttggttctttttgttcactgccatggcttttcatttggatgctcctaaattataattttcctttaaagaaggcaacacataaaatcacatcaaggataccattagatgaaggccagtgaagaaaattttaactgggtaggatcatttttaaatgtaaagggagtatactcaactggtttgtgtcaagctttttctgtgttctatatttgcaaattattttgtagtttcctaaactataaacatatatcagaaatatttttatgacagggtttgctttgccagagaccataattatcatcagctttgcttgccaatgaagaagaatgcttttatctgggtgaatttatgcattgagtgggggtggaagattcttttttgagagagattttcatctccagcctagaggttgggggaaaagctttttagaaaagtagatggaaaaattgatccataaagtttctcatttcaattataaccacacacgatcttggcaccactctaaacaaagtggccggcattggtcacattttccgtgtttagacagaactttaaattagttctgctttattgtttacacccatatttaccaatcaaaatttctcacctgtttaggaagggttttctgatgaggaagacatattggaattagatgttgacgttgaaatctgaaagggaaatgatttcttaatgcaagcatgccttacttagtcataaatggtgacctgagatcctcagaagatatgagccgttcagaagaggcatttccatggcttagtcaacaatctccaaaataattagcaaattatttaatttattcaaaatgtattttttatttttctttggaatcaaaaaactttcattccaggagaccttgcttggtatatttagcttttttttttttttttttggagatggagccttgctctgtcacccaggctggagtgcagtggcatgatctcggctcactgcaacctccacctcctggattcaagcgattctcctgcctcagcctctggagtagctggaactacaggtgtgcgccaccccgcctggctaatttttatatttttagtagagatgggatttcatcatgttagccaggctggtctcgagctcctgacctcaggcagtctgcctgcctcagccccctaaagcgctgggattataggcgtgagccaccacgcccggccgcacatgattttttaaagaagacaaaaggtcctcaaggaactattatccaggattttaatgtctattccctgaggagccaggtactaattcttgattatgatttgagaaaaagttattcttctacccaactctcatacagtgttggtggacacgtatgatgatacaaccacttttgaaaacaactgggcagcttgtaagtagttgaacatagacttactgtatgacccagtgaattctattcctagatataccacatattcagacaaaaacttacagcagtttttcttgcaaaagtcaaaaactagaaacaacctgaatgtccatcaactggtggacggataaaacaaactgtgatgtatccccataatgaaataccacacaacgataaaagtttaccattgaaatatactactacaagatgaatcttaaatgtctatgctgaataaaagaagccagacagaaaagagtgtatactacacaattaaattcatatcaacatctatgaaatggaaactaatacacaatctcagaaagcagatcagtagttgcctggaacgggatgtgcaatgggacagaaagataacaaagattaaatgtaaacttttggacgtatacaaatgcttattattttgattacttgatggtttcacagaacaaacatgtcaaaaatctctaagctttatacttcaggtatgtgtaatttattgcatgtcaataataccttaataaaactataaaaaatgaaaaaagatgttgagctgaggaatttatttacttttataataaacattttcaaagtggccatgatgtggcccttagtgtgccctgtgtctgtgcttatgaaattttaatgtgcaaagatatcacctgggacattgttatagcacagattctggtttagtagttctcggatggagcctgagactttgcatttctaataagctcccaggtgaagccagtgcttctagtccagggatcacagagtgagtggcaagactcttggcatcataaatacagatgaacaaaatacagcctcgtaaagggctctccaatgaatggaacatatatgagtaactgaagaattataaaaagagtgggagggttctgttttgggcattttttgagtatttttaatttgaccagcattcctggtgataacaactataaactctagacaaaatgcaacaaaacaactatctaaaggcatgggataaaaatcagaagaaagcaaatactgcattggagttgacactcgaaaaaagggaatggtacttggcaagtttcccatatttttagattttttttttttgtctgagggcagtctctagtctactatgtagggcaactcaaactcagaatacgtgcagttatactagcttgaaaaatcagatgtcagggtccaagcagattgtggcagctggaaaatggcagggttgggggtaagagtgtggtatatagtaggaaggagagagccacagagagggagctgcaaattttgtgtataaattctgtcctaatctgtggctggtcccgagtcatatacgcatgggtcagatgcccagaaatccagctaaggctaaatgaactgtactaagagtccagctgctgttcacagcaggggagaaatagtttgcagttttgtgttcagcaaagttaacttgctgcttacaaaaataaccaatagttttcaaaggggcataacagaatccagagcttctttgtagtagtcagggttctctagagggacagaactaataggatagatgtatacatgaaagggagtttattaaggagaattgactcacacaatcacaaggtagagtccaaaataggccatgtgcaagttgaggagaaaggaagccagtggtggatcaatccaaggtccaaaacctcaaaagcaggaaagccgacagtgcagcctttagtctgtggccaaaggcccgaaagcccctgccaaaacttgtttaagtccaagagtccaaaaactgaagagcttagagtctgatgtacgagggcaggaagcttccagcatgggagaaagatggagaccagaagactcagcaagtctgctctccagcttctcctgcctgctttattctagccaggctggcagctgattagatggtgcccacacagattgagagtgggtctgcctctcccagtccactgactcaaatgttaatttcctttggcaacaccctcacagatacatccaggaacaatactttgcatccttcaatccagtccagttgacactaaatattcaccatcacactcttcaacgtatcattctcaatacccatggtattaccaaaggttagcaacttgtttctgtaacgagtcagatagcacatattttatactttgcaggccacatattgtctctgctgcatagttttctttctttcttttttaaaacaacagcttaaaaatgtaaaacaataacaacaacattctaagcttggaggaccttaaaaaaacaggcagcccataggtcatagttcgctgatcccagggtaagggaaggattccatgatcactgtgcaagtggaataaaagcttaaagaagttgtttgggtaaaaataaatgtaaatctctcacacaatgacatggcagattgaggttcaaatcacctagagtagcctcaggccaagtaggatatgatctttttgctcaagtgaccaggaagaagtacggtcaacttcttctctggctccatgttggcccaagggaaaaactatgttccttcaagagtacctctaggcccaccagttcatggtcaagtttggtggcattaaagaaaggtatgatagttataaacggctaggtaacaaattactccaaaacataatgtctcaaaacaaccattttattatgttccagaattctgtgggtcagaaatttgggtatggcttgacagggtgcttcctctgccccctatggcattaactggaagttcctgggtggtattcagctgacggatggactggtctggagctcatgatagcttcacttgtgtgtttggagccttgcatagaaggctgggctcagctggggcgactgagtggaacatctacacatggcttctccagcaccatcaagtggagttggactttttttcgccgtgacttagggctttaagagtgagtgtcccaacagagaggatgcagagctgtcagtctcttaggcctgagccctcatgctgtcaaactattggttgagcacagtcaaacttctaccaaattttatgggtcaaagaagtcacagtccatcccaattcaggaggagatcccatttctaaatgggagatcaaacatttttggtcatctttaatttgctatcaagataaattagtgatatttcatgaagaataagattatggtgagtttggtttgatggaattttatcttccttatgctaccagcacacaggaggaatgttatccttacaagaatcacatacacttaaatttcttggtaaacaaatgagtcaaatattttgttattctacactataatataattcgtaacaactaacagtgggataaaagcaagatttggtttggattctgagagaaattggaaagaaaaaggcaaagaataaataagaacttggaaatagggttagacaggaaaggggcatagaacaaaacaatatttaaaagaagagatacattgaaatgtttccaaaaaaggaaggaaggaagacaacaaactctagaggactgatggcaatagaaagctgcagagatagacaatttcaaagtctgttgaatatggggaaagacaaaatcagggggttcaataacaacaaatgtgtgcttgaagccaaagaataaaaataagattgaagtttagctctaaagattacaaggacttcagagactataggagagtaaattactgtagaacacacaactaaatgtaatgttccttttagcatgagtttttagggaaaatgttcccttttacaacagtagctattattgatccaaacttgataaagaacaacttagaagtacctagatttccaatcgagttccgaaacacacacaaaaaaaggaccaaatgcaaaaaaacaaaatccccaaaactccaccaatattttgtgctgtctgctactttaaagtctgtcctcacagacttccacccactgtgaaaggatgagaaaaatctattttctttctgccctgtagcaagaaagcagttgcctctgcatttccttgtagatggaagtgctttttgttctctgggactcctgaatatgcatttgagctgtgaacccggagaaggttgggacaaaaggggcttccctctgaattagcggctcactgaaacaggaggtccaagataattaatctaggagcagcagggatggaggctgcagtggctggaacagccccagagaggacaaaccataaatagacaatgagaaagcaaatattaggtggtgcaaaagtaattgcggtttttgcttaaaagtaatgacaaaaccacatttacttttgcactaaccaaatacattctgttttcagaagaactctgaaaagatgaagcaagttgggaggatatattcatttcatgaacaatataccatctgaaataatcactgcactattcctacgtgcccctcctcaccctaatttctcccttcccccagttcaatcccctgagttttccctcagatcagtattcagagctcagcgtttttaagacggagtctcactctgttgcccaggctggagtgcagtggcgcgatcttggctcactgcaagctctgcctctggggtccaagaaattctcctgccccagcctcccaagtagctgggactacaggcacccgccagcacgccccgttattttttttgtatttttataggagatggggtgtcaccatattggccaggctggtcttgaactcctgagcttgtgatctgcccgccttggcctcccaaagtgctgggattacaggcgtgagccaccgcgcctggccgagagctcagcgttttaaaacctatagtaggctgtttttttcacgtcaatgtcaaatgtttgtgtctgtttttcaaaggtaaataagaagtctgttgtctgttgcagtctgaactctagagtgtaagatctgacatatcaaaggcaagagtaaaaagagaaggtggtgcatgcatgtatggaatgaggaggaaagactcaatgtcatggcaatagcattggaaacaaaaggaggatttggagaggaagacttgaagacccccaaatcaatctatatacaagtaatttactaagtagcaacctgcagctcaaaggtgtcagggtcaatatagctcctaaaatttgagcgagaatacatttctcagctgcaatctaccttgatctcctgtattcaagttgaagattggatatggttaaatctagatggaaagtcatccatttagtggtagcaaaaatagctcagtttcatattagttttgtttttgggcggaccactcaatgtgacaataatggctcctttagactccgttgtgtatcaggcagatgaataagtcaggcaaatataaggcatggccttgtaaatatagcttatataactataaaactttctccacagaaaatatactgtatttttacaggcaccaacagattccatgactctttacagagaatatccttgtagaatttgcatagtgtatacacttgcatgtatacatgcaatgacttaatcatttccaataaaagtgtgtagggagtagctttagtctaaaagagaaaacatggtttggggttttaaagaatcacagaatgctagagttggggaagaagggatcttagagatttgtaactcaatctaactttacttaagtccagagactgttaatggtgttcttaatgtcacacacttggtaagtgctggagctgagacttgaatctgtgtcttctgactccaaatccaccactcttaggcatcttaatattttagccaacaaaattccatggtcttgattgctaatgttgtaataaacggtaaggaactgcgagattgtaccatagacaaactgaatctcagtggctcagcaaagaaaattattcactcatgcaaagtcaagcgcaggtcagtgagaaggcactccctctgtcctgtgaaatagagaaccagatcctctccaacttgaatcactatcatatcaacagatggcttcagtcgccacagcagtgagaaagaggatgtgggctagcacaccgattcttagatgcgtccgtccagaaaggtttatgtgttacttccactcacatttcattggccaggcgtcacatgggtgtgtctaaactaaaagggtctagaaaatctactctccagggagtaagtgagaaatgagatggatgggcgcttgtcacctcttctgtgtgtttatgcctggtttataagaagcacaaagttaaagcattatcactataagatgtatgcaaatgtcagcaatgtaggatcttgggggaaaaggaagtttggaggcattctgggtggttaaaaagtaagaatatcacaaataacctttccactaaattcttattaaagtataaaggcctggcaaaaattactgataacttatgaattcacctcttttagtatgaccgttctaaatccctaggccagaccttacaaacattatgatccaaaatactggccatctgctttggctgtaaaaattcccctgatcagaactctaaattggatctttctttccagggcattttgtagctttcggttggccccatgtcagggagaagctctgcccccaataaaatgaatacaaatatttgtgaagctcatcgaccaccactctaaagccaggtcagacccaggccctggagagcatgtgttttgctggcacatgccacgtcctactcatatggttcagtgagctctggtaaactctgcaaagtttagccacggatccctgttaaagcttgttatctggttcttgttttctaatttgttgtttttaagacacaatatttgttgcctccttatccattttgttgaagggaatgctacaggtgtggtttaccaaatactggaatacggaaataagaggtattttctgatagaaatgttttttgagttggctgtgatactgaagatttttatccatgtgcatgtgtgtacacacacgcgcacacacacacacacacacacacactatgtaaagttctttgaaaaagagtttctcaatccttaacgagcaaacctctggggatcttggtaaaccagactgacccagaaggtctgggatggatcctgaaattgtgtttccaacaaactcaaagtgatacaggaagggggcagggaggtgctgggtagagaaaggtggggtccctggctagggctccaccctcaggcctgtgcccctggacctaggtgaggacaggcactcctgattttgcgcccaaatgttgcattttccaagaccaccctggcccaccatgccccatcctgtgcctataaaaaccccgagacttggctgggtgtggtggctcatgcctgcaatcccagcattttgggaagccgaggtaggcggatcacgaggtcaagagattgagaccatcctggacaacatggtgaaacaccctctctactaaaaatacaaaaactagctgggcgtggtggcacatgcctgtagtcccagctactcgggaggctgaggcagaagaattgcttgaacctgggagtcagaggttgcagtgagccaagatcgtgccactgcactcaagcctggtgacagagcaagactccatctcaaaaaaacacaaaaaaacaaaaacccgagaccctaacgggcacagacacaagcggctggatgtcgagatggacacactagcagaggaacacacaagcagctggacatcgagaggaacacacgggcacacgtcgacaggccatccagggcagaacaacatggacgccgaggagaattcggttggaggagagtcccattgctgggtggtctgactccaggggaagaccaccttcccatcccattccctttctgacctccatatccacctcactgagagctatcaccactcaataaaaaaccttgcactcattctccaagcccacacgtgatcggatttttctggtacattaaggcaagaacgtgggatacagaaaggcctctgtccttgcaataaggcagagggtctaattgagctgactaacacaagccaccggcagatgataaaattgaaagcgcgcactgtaacacacactcactggggcctccagagctgtaaacgctcaagcctagacgctgctgcgggatcagcactccccacaatcgtaccgtctgcatgctccccctagaggtaggagcaggggggcaccagcgaagcgagccacacccccatcgcttgccctgcaagggggataaggaaactttctctgtttcaaaaggtgatgccaatgccacggattcccgcagtggaggagtctagctgttggtgccttacatgggtccactgggattccttttaccaggttcagtgtgcccattccccagtggttatctgttttgctgctaaagtctctgaaggactgaccttgggctattgttaatgtcttgcccctctccaccacctcattctctgcagttggtatccagtgactcatagatacagaggcacaaaagcccagcccccttgccgcaaagagggccaaactcagggtatagtttctgcttcggagctcctcagcagagtgggagcaggctggagataacctcatctgaaaccacataccttactctatcttgcttccctcacttcctgaaagatttctccagagggcattgccttgtacttccatatgaaaccctatctcaagccaggcttccaggaaacccactacagacatttgcaggccataccctgacaagcaagtctagagtgctctagagggagctaaagctgaatagtggacttggggtcaagaaaattgggtttttaaaaatttaaccaacattttaggccaggagctgttacatgttcttttaaaatattaatcgaatcttcactcagtgaagtaggaaactgaagtagaagctgtaattagcgccattttgcaaatgaagaaaccaagagaacaaaataaaaacatccaaggttatccactagaaagtggcagagctgggaaatgaacgcagacagactggttccatagtctgtgcttccagtgctaaatgcccacttcttgcttcagtgactgtgggatgaacttttcagaccctctaatgctcctctgtgaaatagggtatattatctacttttcggattattcaaggattaagtgagatactttatataaagtgcccagtacagagctgggcacattttaggtacatcgttgacctcattaaactagtttctttgttattcacctgggatatctgtctcatctctgccaaccaagacccacaacaggttttaaagactattggccagcctgatgtagtatgtatgttcttttggtgaacagccttcagtttcaggcctgtttgcttctcatagaggttgaactttttgaccatacttgtcaaaagccctaccagattaggttcccagtgctttactagagaacataaaatccaagttgagttctgacatgctgagatttcactcttcagaaagctgatggaaaatgtctcttatttggagtggggagatggttcctgaggggcaacatgcaggccctagaaacatgtcagggtctttacatggaccaaagcctgattcaaaatggcatgtgggaaactacgttgatggatgttaacttcccagtacactaagaggagagttctcctagaagccatagaaaagaaaggctcataggcctacttaagaatcaggaagcacctggtttgaattaatctagaatgcttaacaaagagtaagaagagagagatgaggacactaacacttagattaggctggaaggacacctagaatatgcaatttttttttttctggaacagtgtctccctgtgtcattagcatctccctgtgtcattagcaataatggttcactgcagccttgacctcctgggttcaagtgatcctcccacttcagcctcctgagtagcgggactacaggcaggtgccaccacacccagctaatttttttggtagagatggagttttgccatgttgtctaggctggtatcgaactcctgagcttgagcattctgcctgcctcagcctcccaaagtgctgggactacaggcgtgagccactgcacctgaccatggacatgccacgtttatatgtcctactctaggctaggagctgtgttgcatcagccttgcccactggccagaaggaccagagttaaagtttgagtgaagggcctggcaggtggaaggagctcagagccaacatgctcgctctgtgggagaggtgcacggtcaagtgcaccgggctatagatgtgactcatcaatcagccagtgctttgtgggcagaggagatgaggggccagaatgcgtgtcaccaatttcagcatcacagatattgagagcttccagagcctcacgtttatttggtgtagtgtgaatatttggtgcttcagagacatttaaggttttcttggtccttctatgccttcttatataggttaagcacacttgtgctcagcttacattttctatgacaggggtgtccggtcttttggcttccctgggccacactggaagaattgtcttgggccacacataaaatacactaacactaataatagctaaatcgcaaaaaaaaccactcacaatgtttttagaaagtttacaaatttgtgttgggccgcactcaaagccatcttggcctgcatgtgggccataggccacaggttggacaacgtcgttctatgcctaacacatcgtaagatatttgtttctgtacctaattctatctatccttttttacttgtttcctattgcagaatcaaatattctctaatataacatatataatgaggatattcaacatggaaaaattagtttataaaataaatgctggcaaaaagagatgctggaagatctcaaatgggatggtgagacaactcagggattaataaaatggaagtatctaccatccttcgggctgagggacaaggtgaagagatgcttgataccagaatccagcaatcagggccacctagctggaggtgggaccatggagaggtgatttttgaagcagagagagagacagaaagacgtctccctggcttcttgccttctcctgttttgtctcccatcagtggctgtcatgggttaatgtagtcagaggtcagttagcaagggagcgtagagagtgtaataggtagagagagacccctgtaatagagaggagaggagaaaagatgaagggtggcgaacggtaactggacagtacccaagccagatgtactggtaatcactgggagtgacttgtagtgaggcctaccgggcagggcacccatggaaactctgccttctctctcttccaacctatgtgtgagaaccagtaagctaagaagtcaactaaaagagctattgctctattataatcatggaataattattttaaacccaacggagttctgctttgtgtgttagatcagacccaatgacatctaagagttatatcatcctgtgacatgcctccaagagtctatgagtcaaagaaagatttgtccttgaaagactgaatgagattttaaaagctgatctatgtattcacgcatggtagacaactttaaaactgaaaaatcactatctcaatcactattttgagatcatttaaagaaactattgctagtagagagaaaaagccctatttcatttattaagaaaaaaattctaatattatctacagatagaatatttctttcttttattgatgatgtattaatagcaattagctaaggggagagagagggaatttttatttgtggtgggagtggctttatttaaatcaaacaaatcaaaatactaatagtaatgattcactgaatgtttcttctatatcaagaactgtgctaagtgctttagagcagagcttctcaactcctacactattggcatttggggttgggtaattctttgtaatgagggctgtcctgtgcactgtaaaatgtttagaatcatccctggtccctacccacttgatatacccctcatccagctgtgactaccaaaaatgtctccagacattgcaaaatgtcccctggagggcaaaataaccgctggttaaacacttctttttctttttgagacagagtcttgctctgtcgcccaggctggaatgcaatggtgggatctcggcttgctgcaagctttgcctcctgggttcatgccattctcctgtctcaacctcccgagtagctgggactacaggcacccgccaccacgcccggctaattttttgtatttttagtagagatgggtttcagcgtgttagccaggatggtcttgatctcctgacctcgtgatctgcctgccttggcctcccaaagtgctgggattacaggcgtgagccacctcgcccgctggttaaccacttttttagaggcacgaacccattaccacacccagtgcacaaatgaggcaaatgaagcatacacaggttaaattacttgctctgcttcatgcagatagtgagtggtgcaacaggaatagaacccaggtccaactctaaaccgtatactaaatctcaatgttgaaacttcttctcccgcctgtctcctttcttttgattttctgagaagtatttgtggatgacttttaagaaaatttacataaaagtagcagaaaaagaagcagtcatttttggatttgaatttacagtgagactgaaattggatttctgctgaggtggtagttttatgctgcttagataacgatttcagaagtgtaaaagcctcaacactcatctgtttcagaaaatactactgcggacgtacaaacctttaaaaacaacatctgacggcacctggttcatttcaggtgaagaaaggatgtgctgaaaagcttattttttttctttttttcttttgtgctatgattcttattgaagctcctttctgtataacattgtaccactgcagtaaatgatcaatttcaacttcacgcagccaaggtcaggtgtgagggaataacaggctgtctacgacaccatgtaggcatgatttattgcatttccagaagaggattcttgacattttgaaaatgtaatgtagtgcaacagtaattaagccaaaggtagactgctgaacaattgattagcattgtcagagaagcctgattagcttagatacttccagaactgatcttgccagctatgaattaaaggttagtaattaaatttatgggccatagccactgtctccaggtggcatttcacataggagtatttgtgttctgagaggacaggcaaataaagcaaacgtcagttgccttttcactaacagcctttggttaaaaatatcttttcagagacaaaagaaaaacgatactgagtcaaaacttgtctgtaagttaaaatgttgcttatattatccagtaatgtttttaacaagttctagctaccctgcaatggactaaataaaaaagaggggaaggtaagtttaaataacgtattcatattcatcgtactaatctactaacttgctgttagagagaatatttagctctgagtcatctgatgtgttacttatctatctaggcagcttctttttgaaaattaccccttcctcccctgcatccttctgtccacatatttatggaagcagacatattcactaaacatctttctggccatagctgatgggtctaggggtagatatatagcccaaaccaggtcattcagattctatccctagggttttttttcccaattcaatgacttttagtatattcccagagttgtacgaccatcctcacaatcaattttaggacatttatatcacccagaaataaaccttataccaattagaaatcagtcttcattctgcctcctcctcatccccagccccccgcaatgtctcccatccccaggcctaggcaaccactatttctcctttctgtctctatacatttgtctattctgggtatttcacgaaaatgtagccatacaatatgtggtcttctgtgactgccttctttcacttagtataatgtttgtaaggtgcatccacgatgtagcacatattaattttattcttttttatggctgaataatatcccattatatggatatatcgtagttcatttatcagttgatgaacctttgggttgtgcttgccatgaacatttgtgtataagtttttgtgtggacatgtttttatttgtcttggttatttacccaaggaggaaaattggtaagtcatgtgattactctatgcttacattttgaggaaatgccaaactgtttttcaaaatggctgcatcagtttgcattcctagctacaaagaatgagggtgttaatttctccacatcttcaccaacacttgtgggtccatcttttttattgcagctatcctagtgggtatgcagtgacatcttatgtggttttgatttgcatttccttaactactaatgatgttgagcatcttttcatgtgcttattcgtcacttgtatatcttctttatatagatgtctattgaaatctttgctcattttttattgagttgtaagttatagatatcatatatctatatagatatatctacaacttatataacttatgcattgtattaatatataacatattacatatataacttatataaatatagaatttattatatatatatcttacaactcaataaaaaatatattttttcttaaacagcaataccagcctgagatttatatatttttgatacaagtctcttattaggtatgtaatttgcaaatattttctctcattcattagattgtattttcatttctttatttcacttaccttttagagaaagggtctcagtctgtcaggctaacatgtagtggtgcaatcctagcttaccacagctttgaattcctgggctcaagcaatttttcctgcctcagcctcctgagtagccaggactacagccgtgcatcatcatgcccagttaatttttttcttttattttttttaaagacagaatcttgctatgttgctcaggttggtctcaaactcctggcctcaagtgatcctcctgctttagccgcccaaagcactgggattacaggagttagccactgtgttcagcctcttttcattttcttacaataggaacgttttttgaagttttgatgtagttcaatttatctactctttcttttgtcacttgtggcttttcatgtctcatgaagaaggtattgcataattcaaagtcatgaagatacatttatgtgttttattttaatagttttatcgttttaggtctatggtccattttgagttaatttttgtgtttgaaataaggtaggagtccaacttcattcttctgcatgtggataaacagttgccacagtaccatttattggaaagctactcttccttcattcagttgttttggcacctttgtagaaagtcaaatgaccgtaaatgccagggtttatttttgaatagaattttcaattctattccactgatctatgataccacacttccttgattactgtagctttatagaaagttttgaaatggggaagtgtgagccctctgactttgtttctttaagatagttttggctatattgagtttgttgcgtttccatataaattttaggatgagcttatcaatttctgccaaactggcatctggaattttgatagggattgttttggatctgtagttccacttggggagtattaccatcttaacaaataccatgcttttgtatccatgaagacttgggagaaagatattatatgttaccatttatttagatctctaatttattgcaacaatgttttgtagtattcagagaacgtttgtatatcttttgttaaatttattcctaagtattttattctttttgatgctattgtaaatttcatcttggaaatttaaaataaagatgaaacaatctcagcttcagtttacctagtctcttgaatggctaaaatgtaaatttagctattgttggtggccattttctgctttgtggtagaagtataaaaaagccacaatgtagtcttaaaacacaaaggaatcacagaaatgaaagatgtagaagactcccaggatttctccttgtgctcaaggcactgattttagctcagttttcaggccaactgcatctctatcctttataacaatcctttgcttttgtttgtgttacctgcactggatttctgctctgcttgactaaaagtcccagctaacacactactgccatgcagaaaacaaaacctgttattgctgtcatggaagaaatgggtcacttcaatgacatttccatctctcagctcttaatcactcatttttatctcaagtgaaataaacaacataatattttaatgatcatcatctatcctgtgaaatcacctaggcacattaagctttttggcactctgatcatattaaactactcaaattatagcagaagtgccaaagctatgaaaaccggcattagatgtatgtaattgagcagagggtttaatgctgacttctattggacagatagtttactgaacttgatagctgttaaaaattagcaatataaagtgaaatagttttagaaaccttttagcaaagtcaccagcctaaataaatcctttggagctacgtgggctttagaccactaattctcaaccctgattttgatatatatttgtcatcaattatcacaggggatattatgaaattttaaaaacacatctaggttgaatttagtcattttaatatacatttatagtgtttaaatcatattttgggaaatatgacatgtaagtctttttcctgcaaggtgactcatatccagaaagccagcattccagggcattttgtaaaagctcaaaaagcaatatcttttagtgagtgaagccttcaaatctttgtctattaattaaaccatatcagtaatatagtatttaaaattgtataggtcatcctttgttttggtagccttacttctataaaaatgtcctaataaaattatcagagatgtgcattgaggatgcttgatgccatattatcaataatagtatgaaaagtagagagaaactaaaagtacaattgggattgcattaattttggcctgttcacatggtggaaaattaaagagctattaagagccatgttgcagaaaaacttttcatgacatggaaaagttttccaacacagtaaagcaaaaaaaaaaaaaaaaaaaaaaaaggagtattacacaatattccaattcggtaaaataaattttatgtaagtctccatgtttatgcacagaaaacaaacatcgaggaataataaattatcttgggtaataggaaggcgatttgattcttgtattcttttgtactttccacatagcatttattaccattctcataagaaaaagtaaatgatatcctatcatatttattttcatatgagtaacaaatgatgtaaatggcaattatctcttcaggagacagaacactgtgtttcattctatctgaattgaaggagacagtgtcctagacctgactcagctattgaattctctctaaggataagaaaaaaaaataattgtgtttccctatgtgccagctttctgtcctaataatacctgtcctatctacctttcaaggttgtactgtaacaaggagctggtgtaataagctactttgaaaaacataagaaaagtgaaagatattattattaatgatcatttatgaagaggtagtaattaacatgtaatattattatgtagtagacatttagcctataataatggcataagttagtatcagaaattattttataatagaagttagattttaataaatgttttggctgaatggcttctattttcctaagatttctaaagttacaagaattaagagatcctagtcttccatgttctctttgattccttttaaaagagacaatgcgtgatgtgtagtaatgaagtactataccactgacagaatttagttatttaatttagtacttaaatatttttattaaattttaagccagaatgtgggaaagcatataggaaaaccttaggtattctgctttctgtaataaccccaatagctttctctagcttctagaaaggcccaacttgtcacacttaaacttccaagtccagtgtgttcttgttctccagctttccaaaactgctctgggctccacgtcccagaacacagagaacttcttcaccttctatttttggtcctgaaccaatgagcgaggagacatcaaagagcctataaatcccttcctcttggtccccaatgacagatgacagtaaatcacttttgttctccccctcaagacggagtcttgccctgtcaccctggctggagtgcagtggcacgatctctgctcactgcaatgtccgccttctgggtttaagcaattcttctgcctcagcctctggagtagctggggttacaggcccacgccatcacacctggctaatttttttttttttctgtatttttattagagacggggtttcaccatgttagccaggctggtctcaaaatcctgaccttgtgatccacccaccttggcctcccaaagtgctgggattacaggcatgagccaccacatctgacccagtaagtcacttctaaagggaagaaacaatttattttgttttgttttttttcagtaagaacatattatcatattatatcatgatataatataaaatcccttccaataaaccaatagccaaaattccatcatatggcagagtctgaaatcaagtcttcatataattcaattcaccactgtgatggttaatattagatgtcaacttgattggattgaagagtgcctagatagctggtaaagtattattctgggtgtggctgtgacggtgttgccagaggagactgacatttgagtcagtggactggagaggaagactccccctcagtgtgggtaggcaccatccaatcaaaacaactagaacaaagcaggtagaagaaggtgggttaagctggcttgctgagtcttctggctttcttctttctcctgtgctgaatgcttccttccgctcctcctgcctttggacatcagaatccaggttcttcagcctttggactcttggagttacaccactggtttgccaggggctcttgggtcttcagccacagactgaaggctgtactgtcagcttccctgcttttgaggcttttggacttggactgagccactactcttccccagcttgcagacagcttattgtgggactttgtcttgtgatggtgtgagccagttctccctaaaagactccccatcatatatgcatatatcctattagttctgtccctctggagaaccctgactgataaaccaactacatcaaatgtatcagtgtaatcaatctacataaatgcaaaatatatatacagcaaacatttagtaatggtttactaggtgtcaaaaactatttttttttttaaagttttgcagatgatgaaactgaggcccaggaccacttgcccaaagtcacacaacttacaagttgcagagatggaactcaaataaagattagcttaatccttacgtatgtttcatactagtttttaactctgatttgggaaactgattgcctgacacggaaagatatttatttctaccgtaagtagattatatcctccaccttgccaacagagcaaggacacaggcactgaataaactgtctgaaccaaaaagctgtctgaatatccacttctaagttttaattggtgagagtatcagtatttcattgagctgtcgggaatctggcagttattccataggattttgagactgtcagaaagataacagtaaaggctattccacaacaaggagaaaaatgtgagtacattatgtaggttctcaatacaataataagtgaatacacaagagaaggtaaaaaaacaggcaccaagaatacatacatggattctgattctagtgatgaccatgtagctcctaacaggcaatgcccttacgtaaatagaaatataaaaacaagtatctagaggcactggaaagtgatgaaggtgatactggaggagaattatcccttgcaagaagggaagggtactggatgaatttcctgatcttttacaaccttcagcctgatgctaagttttggtctgttccttgctggctaaattcagacagaacacctgtagtcttattggcttgaggtaccagaggacaaagtttagagaaacgagagatgtgggaaaacaatggagaaaattccaaaaagaagagattcagaaaatggaagcacccatttctgcgtatacattctgcccaataaggcaggaaccgaaaaccaaatatgcatgttctcacttataagtgggagctaaatgacgagaacccatgggcacacagaggggaacaacacacactaaggcctattggagaatgaagggagaagatcaggaaaaataactaatgggtactaggcttaatgcctgggtgatgaaataatctctacgacaaacccccatgacacaagcttacctatataacaaacctgcacatgtacccctgaacttaaaatgaaagtttaaaaacaaaacaaaacaaaaaaacttctgcccaaattgatacctgaactgtgcacgagtagggaagactccaagtagcccacgtgaggctaaaaaaaggcgcaaattaacattttagctgtaagccactgcagagaggacaaacttatcaagttgagtttagtcaagttaagcactacttgaaaaaaaaaaaaacaaaaaaactaatactcttcagagagagacaacagaatgcagaatctctatgatattattcacaacgtttccaatcctatcttaaattactcaacatatgaagaaattaaaaacattatccaggaagagaaaaaaaacaatctacagggaccaacctcaagatgacccagatgtcaaggtttattttttaaatgcttataatgagtaaaaagaaagaaaatctcagcagagaaatagaactttaaaaatgaacccaggctgggcatgatggctcacgcctgtaattcccttgcaagaagggaggcccacgcaggcagatcacttgggctcaggagttagagaccagcctgggcaacatggtgaaaccccatctctacaaaaaatacaaaaaaaatagccgggcatggtggcatgagcctgtggtctcagctaattgggagaattgctcgaaccctggaggtggaggttgcggtgggccaagatggcgccactgcactccagcctgcacaaagagcaaaaccctgtctcaaaataagaataaaaatgaacctaacataaagtccataactgtgttaggccattcttgcattactataaagaaatatctgggactgggtaatttatttaaaaaagaggtttgactggctcttgtttccgcaggatttacaggaagcatggtgccagcatcagcttctgctaagggcttcaggaagcttacaatcatgaagctggaggaggcatctcacctggcaagagcgggagagagagagagggaggtgccagacacttttaaacaaccagatctcccttgaacttactcatcaccaagggcatggcactaagcctttcatgagtgatatgtcctcacgatgcaaacacctcccaccaggccccactgccaacactgcagattacatttcaaaataagatttggcaggtacacaggtccaaaccatatcaataactgaaaaacataatatctgaaataaactgttagagcctagcatattggagatgacagaacaaagagtaagtaaattttaaattgattaatagaaattttccaagctgaagaacacagatgaaaactactagaaaaaaaattaaaatacagagcctcggggacctgtgggacaatataaaactatttaacatacatgtgatttgagtccccgaatgaaagaaaagaacagagaaaacatctttagggtaataataactaaaatttctccaaattttataaaagacaaataaacagattcagaaatgccagcaaaccaaaagccatattcgatgaaaaccacacctaggcagatcattgctgaagaccaagattaaagagaaaatctttaaagcagctagagcaagatgatatattacctataggaaaacaatttgaattattgctgacttctaatcagaaacaatggaggccataagacattatctttaaagtgctaaaagcttttgtaaaaaaatccagggctaggtgcattgtctcaagcctgtaatcccagcattttgggaggcggtggtggaaggattgcttgagtccttccacctcaaggattgcttgaggagtttgagaccagccctggcaacatagggagactgtgtttcaaaaaaaaaaaaaaaattagctgagcatggttgcacacatctgtggtcctagctacttgggaagctgaggtgggggaatcacctgagcctgggaagccaatgctacagtgagccatgaccacactactgtactccagcctgagtgacacagcaagactgtctcaaaaaaaaagaatttcagaatttgaatccagcaaaagattatttaagacaagtggtgggccgggcgcggtggctaatgcctgtaatcccagcactttgggaggccggggcaggtggatcacgaggtcaggagatcaagatcatcctggctaacacggtgaaaccccgtctctactaaaaatacaaaaaattagccgggcgtggtggcgggtgcctgtagtcccagctactgggaaggctgaggcaggagaatggcgtgaacctgtggggcggagcttgcagcaagccgagatcgcgccactgcactccagcctgggcgacagagcgggactctgtctcaggaaaaaaaaaaaaaaagaaaaaagacaagtggtgaaataaagacatttcaaatagatgaaaaaatttccaaagaaatatagaaactttgacacatgatcaaacctaagaacttgtctctaaaagaaccattcggttaaaaaaagataaaacttaagaactaaagtcaattctttgtttgtttttcgttttgagatggagtcgcgctctgttgcccaggctggagtgctgtggcatgatctctggtcaggcttgtaatcccagcacttttggaggttgaggcaggcagatcacttgaggtcaggagtttggattagcctggccaacatggtgaaaccccgtctctactaaaaatacaaagattagccagcagtggtgacaagtgcctgtaaccccagctgtgtgggaggctgaggcaggagaatcgcttgaacctgggaggcagagtttgcagtgagccgagattgtgccactgcactccagccatatatatatatgcactccatatacatatataaatatatatgcactccatatatatatataaatatatatgcactccatatatatatataaatatatatgcactccatatatatatataaatatatatgcactccatatatatatatgcactccatatatatataaatatatatgcactccatatatatatgtaaatatatatgcactccatatatatatatgtaaatatatgtgcactccatatatatatgtaaatatatatgcactccatatatatatgtaaatatatatgcactccatatatatgtaaatatatatgcactccatatatatgtaaatatatatgcactccatatatatgtaaatatatatgcactccatatatatatgtaaatatatatgcactccatatatatatgtaaatatatatgcactccatatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtaaatatatatgcactccatatatatgtatatatatatgtaataatatgatgatagcaaaaataatggcgatagagtgataaatgttacactggtcttcccatacattttacataaaatgaaacaatataaagtctaagtagattgtgaaaagttaagaatgtcacattgtaatccctgaagaaactctaagaaatggaaagagatagctaataagtcaacagatagattgagatggaatttaaaaaatatccagttaattcaataaaaggcaagaaagaaaatccagaggaacgaaaatcagagtgggcaaagagaaaagaaatggcagaacagtagacctgaattgaactatattagttaactaaatgtaaatggatgaaataatccgattaaaaggcagagcttgtcagaatggattaaaaaaatatatccaaccatatgctgtctatagtagacacattttaaataataataagagagagataaggtaaaattaacagatcagaaagctacatcctgcaaactgtaagccttttaaaaggttggagtaagtatattaacattagacaaagtagacatcaaggcaaaaagtattatcagagataaataggaatatttcatgatggtaaagggtccattcatcaggaaggcataacaaatgtaaatgtaaatatgtctaataatagtacatcaaaatacatgaagtaaaaattaacaggattaaagagggaaatagagaaatccacaattcttattttaattttcctcttgcagcaattgataaaacaactacacacacacaaaaaatcagtaaagatatggaagatttgaacatagtatcaactcttgacccagttgacatttatagaacacttcacccaacaagggcagaatatacattcttttcaagtatgcatgatcattattaatacatgcacccacagccatttggtggcccagagcatgaatctcaacaaatttaaaagaattaaaatcattcatagtgtgttctctgaccaaacagaaatcaaatcagaaataagtttaaaaaaaaatatatatatatataactcaaatccttggaaatgaaacagcacacttctagataagttaatgatcaaagaaaaagttataaagaaaattgaaacataattttaactaaatgataaagatacaatatgtcaaaatatgtggggggcgggcagcaaaagcaatgaatgcttcacggaagatttatagcttcaaaatattacatgagaagaaataaaggcttaaaatcaatgatctaagttttcagttaataaattagaaaaagaagaacaaagtaatgtcaaagtaagtaagatgaagaaaatcataaaagttggaagtcaatgaaacagaaaacatacacgtaattgggaaaatcaacaaacccaaatctttaactagaaagatatgtgtatgtataaagagagaatatgaattaccagtaccaggaatattattctagaataaccaggagaagttattctatagacattgaaaggataatcaagaaattataaataacttaatccatgaaattaaaaaaaattaagtaaaatagacaagttctttgaaaaacgtaacttactagaactgaaaaaatatgaaacagaaaatttgaatatctctatttctattaaagacattgattagttgtgagaaaactttctatacagaaaactccaaacccagatagttttattagtaaattctatctattaaagaaataataccaataatgcacaaattcttttagaaaataaagtagaaagaatatttttaaacacataaggctagtataatcctgtcatcaaaatctgacaaagatattacaaagagaaaaacatatctcatgaacatagatttaaagtccttaacaaaatcttagcaaagtgaatccagcagcatataaaataaatgctctatcttgacctagcagggattattctaggaagtcaaggttggcttaacatttaaaaaaatcaattactgtcatttgtcaaatagacagaattaagtgaactggcttttctatatgacaaaacattatatactaatttaaaaatatcatattttctctcagtttattatcctgaagagatttgggatggtggggggagggcaaaaaggggaaaagggggaaaaactaataaagtaaaatatatactgctatagttcggatgtgtgtccctgccaaaatctcatattgaaatgtaatccccagtgttggaggtggggcctggtaggaggtaattggatactgggggtggatttctcatgaatggcttagcgccatcgctcatagtactgtcctcgtgatagtgagttcttgtgagatctggtcgcttaaacttgtgtggctgtccccctcactctgttgctcctgctctgaccatgtgaaatgtctgttcctcttttgacttctgccatgattatcagtttcctgaggcctccccagaagctcagcagatgctggtaccatgcttcctatacagcctgcagaaccatgagccgattaaacctcttttgtttataaattacctagtctcaggtatttctttatagcagggtgagaatagactaacatacatatggaataaaggcttatgagttactggtttattattattactgttgttaacctttcaataatttgtgcttggaggagctgcccctctatgtagctcaggtacattttttttttttttggcaattctgggaacaatcatttctaaagaatctgaaatggtttgcacataattgcttgaatgtcaccactgaaatcagtatttttaaaaaatatttattttcattgaagttcacaaagaaggaatttaaatgttccaaaattaagggctgatgttgatacagagaaagacagcaacatttccatagtattgtatgaacaaatgagattcaattctcagaggatttcatcctgtcttatcaggtactactggttaatagaccagagaaaataatgatacctgttaatttattcagggcttattattcactgggcactaatctgagtgctagatatgcactacctaatttcattttgctatattctgataaccctaatgctattacataagcattgcacataagtattgtacaacacattgtacataggaagaaactgaggcacaaagaagtttaataccttacccacagtcacacagcaagtaagacggcagagccaggatttgaatctaggtagctggctgcaagcctgtagtgaaaattgtttagatgtgactctcaaaaactttttttaaatctgatattcatatgtctgtgggtacatttaatatgcttcaccccaaatatctgatattcatatgtctttggtacatttaatatgtttcaccccaaattgtaaagactaaagtactttttttttttttttttttgagatggagtcttgctctgtcacccaggctgtagtgcagtggcgcgatcctggctcactgcaacctctgcctcctgggttcaaggcattctcctgcctctgcctcctgagtagctgggactacaggctcccgccaccatgtctggctaatttttgtattttttggtagagacggggtttcatcatgttggccaggctggtcacgaactcctgacctcaagggatctgcctgcctcgacctcccaaagtgctgggattacacaggtgagccactgtgcccagcctgaagtacatttttataattacaagagtctataaaacaaataatttaaacctattcatccaaatatgtactagagaatgaaattagctcacacattccacaaagggtgtggataaaagaatactaaatgtaaggtgaaatgcttgaaggaggcagaaatgattggagacagcctccttgggatgaaactcaaagaaattccatgagaggcatgggtatattagagcagacactcaatttgcacgagagataggggctgaaacctcccaaacacttctgaaagctatcttactctataatgcagtaaagatgaccaacatttaagggttccttcagacacttaaggagggttgccagactcacgatatactcattgctaaggcagggctggggatacagaagaaaacagaatcaggacttcagctcatgagcaagttcctttcaaaggcgttctgctgcttcccaaagcatctctaaaatgtttacttagagtcttttaggcatctgggacataatagctggaataaaaacactaggcgcattctagtttttagaactacggagtatgagtcaagattaaatattaatattacattgtgtttgtatccaaataaaatattgagatatgttgtcaagagttactcttcacctatgatttctgctccttcaggtttcaggatgaatacaacttcctattattttcctttgtaatctttgttgaggcttgcaattgcagcattatttgcctgccttattaactatttatttattgtttacctcctctgcaccagatgtcaggaactttgccagtcttactcagcactgcatcctcataatggtgtctgaatcccagggtagtgcctggtgaaaaacaagagcttaatgactaaatgaatgaatatacaaatgaatgaatgaatgacgcagaatttaaatgtggatgtagggtgatcagtaagcctcagtcactaggtaattgactcatactcaagtatttgttttatagcctgtagtataattccactaagtggctcagcaaaattataagcatttatattcatatgcccgctatctcttgaattgctgaaactagaattaccaagtgtgcaaattctgagaatctcatgtgcagcaagtcaaatcctagtgcatataagaattacctgcctggggagctttcaaaatgtcatttcctagcttccatcctacctgtgctaaaatgaccagtagacagagaattagggaatctagaacaaatcctgactctgtaaagactatatgaacccgggcatggtatttatcatttttttgcctttctgcaaaatgagaagaatagattaaataaagtttgactttctttctgtgtatgcaggtctgtatgcatttgagccatgtgttaggccttatattgagtataaagaaatgaaatttatagttaaagtctaactggcacaaataaaagtatgtatttacagagtgcaatgtgatatttgatatatgtgtatactgtaaaatgattaaatcaaactaacatatctatccacttacatatatacatataatgttttgtggtgagaaaaattaagatctacttttttggcaattttcaagtatccaattcgttattattaactataatccccatgctgtataattgatctccagagcatattcatcatgtctaaatgaggctttgtaccctttgaccaacatctccccattggaagaaaatcatttaaacgaaacaaaaatgaaataagagtaccaaatgacagttgagagttaccacctttcttgggccctaagatgcacatctttccttccatatttaatgtttttgaaattgagatgcatctaacaattgaaattaaaaaaaaaaaactttcaaagaagagaaataaattgtgacatcatcatcttcccctgcatattaagtaaatggacccatttctagaagggacacctcacggtagtcctgtgaatcttaactgaacctggggacacctgacagttgctttatgcatttggaaaacatttcaggtgttttctaaaatgataatactgtgaggcaatcctgaaacaaaaatatatctggtaagcagaggactgctggtaacacagcaggcaacacaaataacatcaggagaatctgcgaaatttgtcaggataactcatggaaattcaaagtgaagagaggttggcctttttgatttatgtatcttgaaaggctattatgtatcttgaaaggctacgttgctgaacacctgcccatcagaaacccttgtcacttttaagagaagctaaatatgtaattatgtttaaggagaaggcaaaatgatatgctcagtcaaatacaaaatgcagaggaagcctcagtatgctttaatatatctcaagaggaatctgtcagagagcagatcagtggttgcctggggttggtgttgggagagggagggagggataacaaagggggtacaaagaaactattgggggtgatggatatgttcattatcttgattgtggtgatagtttcacaggcaaatacaaacatcaacacatcaacttattcattttaaatatgtgcatttttgtgtccttcaattattcttcaaaaaatggaaaaggtgtttattttgtcaataatgaaaatccacagaggtcaaggtcacagggatggattattgaaggaagtaagtcatgagaagacatgctgaatgattcaggagactcttcagaatctgaataacgatatcatcatccccttctcaccaacactattatttgttaagcactcactcttcgtggacctggcattctacaagaaattttactgtatcatcacatttaatcatcacaaccaccctggaaggcttatctcactattacctccattttactgataaggaaatgaagccatataaagggtaaaacttgccccagattgcagaactaataatgcaggatttgaaccagtcggaatccacgctcttaaactactcctctagctggcccttaacactgggaataaaacacttaaacactgctattcgacaggatttctcatattgctagctaaggatagaataaagagcaatgatatccctttaaaagttctataacttgatcaaattggagatctagcagcacaattcacaactgcaaaaatatagaaccagcccaaatgctcatcaagcaatgagtggataaggaaaatgtgatatatatatcgcatatttatataccatggcatacttctcagccatatatataaaatatatcaaacatatatacaatatataaaatataaaacatatatattatatatataaaatatatatatactcaccatggaatactactcagccataaaaaagaacaagataatgttatttacagcagcctggatggaattggagaccattattctaactgaagtaactcaggaatggaaaatcaaacatcatatgttcttactcataagtggaagctaggctgtgaggatgcaaaggcataagaatgatgcagtggactttggggatttggggaaaggggtgggaggggtgagggataaaagaatacacattgggtacagtgtacactgcttgggttgtgggtgcaccaaaatctaagaaatcaccactaaagaacttattcatgtaaccaaataccacctgttcccgaaaaccaattgaaataaaaaaaaaattctataacttgaaagacctacatgaatatatcaaatatctggcatattcgagggtaaccataagttgaaagtctatcctataaacagtacttgaggactttagatgggtctgtagtttgatcattctgtagttacggttttcagttgcggtgagcaagggacagaggtgcctaaatttaggtttggtatttctttttttctttttttttttttttttttgagacggagtttcgctcttgttgcccatgctggagtgcaatggtgctatctcagctcactgcaacctccacctcccaggttcaagcgattctcctgcctcagcctccccagtagctgggattacaggcatgcaccaccacgcccggctaattttgtatttttagtagagatggagtttctccattttggtcaggctggtctcgaactcccgacctcaggtgatccacctgcctcggcctcccaaagtgctgggattacaggcgtgagccaccgcacctggctggtatttcattactttttaagaaaaagggtggtgaatcaaggagtctagagggacttggaaacactgaacatttccaagcatcatgctctgtgaggtgtatattcttggttgttgccttatttatataacataaaatatattattgtagccacttttaagtatacagctcaatgacattacatatatttgttgcctttttttcaaaggtagtatttcttcctgaggagacagttgtgtggtaaagttgcatgtgtgctgcagtctaatagactggtgtttgatttccacttctgtctttttgtagggtatgaccttggtcaatttgaaaacctctctatccttcagtttcctcatctgtaaaatgatgttgatacaggcctaccagacagtactgttgcaggcattaatcaatataatgtttggaaattgctcagtataatttctggcatggagtaaaagctttcaatatgctgtagaaaatgtagctattataaatccatcaaacgtttctgcaagtcagtgattcttaacctcctggagaaagctgaacctaagggggtcctgaattggatttgaggggtcctataagtgtcctaaaggatgcgtaaattcatgtatcttctctctgtaagtgtttcggaaaaagacacacaactttcaccagattttcaaagaagtattagaagtacaagggtgaaaacagaaaacttattagagaaatatatatgaccagatcaacctcacttaatctgctattcggggctttgacctttgacctaagtttttcccttccctctgtaggtattgtgggtaagtagaagagcaaaaggcttactctttgtcttagggatacctaatggtgttgcatataagggggtataagtcacaccccctggagttgtggcctgcagtctgcagagtttggcctacttttcccccacacccttggcacagtgcagctgcatggtcctggggacacagtgctaactggacagcagggttgctatgagattgtgcatgggaagacaaggaactcatagagttaagatggcttcacagcctgtgccctcacttggctgtctggaccctagcctttcatagtacagcactttgcacatacgtctaacaagatcacctgggaaacttgcaaatacgtggtaggtctggagtggggctgagattgtgtatttctaacaagttcctaggggatcacacttggaatagtgaggctctaaccttttcatgttagtttatttgtctgtttccccagttgtctctgggcaaaatgaaggcaggggacaggaccttgtcttattctctttctgaggggtttagtacagaggtgacatataggttgaaagtaaatgcttaagaagtgtaaggaaggaaaaaggaaggaaggagagacggaaggaagcaaggaggaaacaaaagaaggaaggtccgggcatggtggctcacacctgtaatcccagtactttgggaggctgaaatgggtggatctcttgggcccaagagtttgatgccagcctaggcaaaggacaaaaccccatctctacaaaaaatacaaaaaattagctgggcatggtggcactcacctggggtctcacctactcgggaggctgagttgggaggatcacctgagcgtggggaggttgagggtgtcgtgacctgtgatcatgccactgtactacagcctgggtgacagagcaagatgctgagaaaaagaaggaaggaagaaaggaaggaaggaaggaaggaaggaaggaaggaaggaaagggaagagaaggagggaggtgaggggagggacagaagggagggagggagggagggaaaggaggggaggggaggggacagaggaaagaggagagtggggagagggaaggaggggaaggagagaatggaaagaaaggagagaaaagaaaggtatgtagttttgagcagaaaggggttgtacactgaaggcgtgtaagcatgtagttgtcataactggacagattttccagatacatttctgcctctaagatcaaagtttcttccctctctgagactcaaggaaggcactccgccagaaaaaggagaggaaatagaagtcaccaagctgaccactaatcaagagactgaagtttgtctccaagagacaattctctaatttctacaaaatgagaacatttactgtataatgaaattcattgtgcagaacatctcctgagcataaaaatctacaagacgtagacagctgctcatagggccatttttaaacaccttcttttggagtaggctgttctttgacatggactgcaaagttttacttatgcagttattttatcacctttatcgcaaatgcataaaaagtaaagactcaaggaaagaaggaaggttctaaaaatattcttcatagaggcagacacaaactggggttgaaaagcccaattatcttctgtcacttatatcactctagttggaaacagctttaacatcgggagtgaccacatattacctatcctgctcagagtcaccactgcatttactttctagtagatgatttaacagacagacagagaatgtgagtgccactggttagaacatggtttctaggtgtcacactatttcatcaggcaatgatgaatcacactgcggctctcacatcgactttcccacgacctctgagcaactagagaaagccaaagaacaattctgggagtttgatttccctaacaaagcaacagaaggcccagattaaactggcctctttgaaacttaaaaggaaccaccattttgtcaccttttaggggggcaagctgattaatgggcagcgaataatcacaagagaattcactgattaaatgtgtagccattgtaaatgcagatccaaacccttagaaagaaataaatgcagacccttcttgagtttcgctgattctgctcatatgttttgtatttacaaagaaaataaaaattgtcaaggcaatttttaaggaagagcttaagaggaaaaagcaaacctttagcacaagttgcaaatgcagttagcttattaaacattatcttattcaacccatcttatgccacatcccaaaaagggcacagaaactggaaaaaaagcaacccatcctgactcaaatgtcaactaaaatgtctgaaagtttccatgatgatgttgataatggtgatgatgacagcaactaagttgtcatcaactggatactctaagtattcttcatatattaagttgtctactcctcaacaaaatataaaatagatgcttattaactccatttttacagatgaggaatctgagacatacagagtttaagtaacttgtctaaaattacataggcggttaatggcacaatttactcaactttgggtaatgtggccttggtacatgtgcttttgagtcctcctagcattgatattgatgatatgaataaactaaatgatgtgctcccatgacactgcagtttccatggtatttacttcaactgtctatgaagtagctctcctggctctaatagtccataagactgtaaacctcatggaatagtcccattccatgagcaatggttcaataggcaaatgactttagttgagtggttcagtccatatcaatctaataataagtgcctattaagtcctggttgtggcacaagagaggagagaggatggtgaggggagaacattaaagaaacatagaaagatggccctgtccttatgtcacatcttctaaaagatgtgcttgaattaaagatgcttggattttgagaggttttgccaaagagtactgtattaccactataaagggaagccaagagtgatagaggtaattttcaccatccagcatcctctcactcttccattggtaactgcatcctgaacttctttcaaagtacctaatctcctgtttccccaagatgcacagtcttgctttgatgtcagaggataggtaagtgccctgaatcctgccagagtcatcctcttggaaattcaaattttgagcagagtcatacatggacaaaaaaacttcaacatcaatgaacatttcatacattcatcctcggtatctgccccttgcaggtactagagtccagagatgctcaagtccctgctataaaatggcataatagttgcatataacctacctacatcctcccatgtacatgaaatcatttctagattacttataatacctagtacaatggaaacgctacataacagttgttatgctgtattatctttttttattgttgtattgttatttttattggcttttcctgaacattttcaatctgtagttggttgaatctgtagatgctgaatctacagatatgaagggccaattgcactgagttggagaagcttaatccaattctgctgcctggaaaaccagaccccagtactaccctgctttgtgcccttctggatcttgttctttaagtgttgctttgattctgtgtgatccctcatgtccttcaacatattcatttttggcttaagttgtccagtttttgttccttgtaaccatgtaaccctaactggtacaccacaattacacattcagttattctatgttcctgttaacatttaattacatgtatctcaagtcactttatagaagcattgttggtaataaaggggaacaattaggtagggtttaaataagcctgctgatgaaagtcaatgtgactgtattattccagaaagaaaatacattgaaaatgtcccccaaactctttctgcatttatttcattaactgaatggaatagtgaatcaagaatcagaagacctaactgctagatccagcccaatgacaaaaagtttgtgtgagcttgggtaagtcactttccctctctgaacttatttcaaatgtgtaagatgaagtagagagggtctttgagtgttcctctcataagtcataaggttctaaatggaaaaaatgtgccttagaaattactgaggaattgagtagatgcatcttgaggcctcttttttttctgaaaatgaagacattttcctcatacagattagtaaacagagttgagttctaaatggacttcttgaagtagaaatgtaacagtgagcgtgttatgaaagacccaggctatttctcatgcctgtaattatcttatattcaaggggagaactccaaaggtcaggattatcaaatagctcttccgttacctgactggaagctagttatggaccaatcccaagaaggtgagcaatttgtatcatttaatttttagctattaataagtgaatttcagattaatttggatcttcaaaggaaatgaagcaaaatgaatcataaagcttattgggttatttccttggcaactattcaaactttatagtttcaagttcagatatattgccaaagaggaacaaataaaaaaatacaactgtcatttgaaataaacagtttgaatcctgaaaactatttatcttttcttttctttttttttttttcctgggacagaattttgctcttgttgcccaggctggagtgcagtggcatgatcttggctcactgcaacctccgcctcccgggttcaagcaattctcctgccttagcctcccgagtagctgggattacaggtgcctgctacaacgcctggctaatttttggtatttttagtagagatggggttttaccatgttggccaggctggtctcgaactcctgacctcaggtggtcaacccacctctgcctcccaaagtgctgggattacaggcatgacccaccgtgccccggcctatcttttcatctcatttcctcatcttatacttctctgacttccaaaggccacccaaaccacaagtctcctaaagtaactcctgctctgtttctgcttattctggggttcattccttttgcaacttaatgagatcacctcccagccctgtagtcagtggccctgtgctgagcaaaatggtctgttcattcagtgaaaggctaaatatcaaagtactctgatgaattttacctggagctaaactcatcagacaggataaaagaacattatcgatgggaaaatttacttctttcaaatatcacagaaacttacacacacaaaatgataaaggtataagaaatactaagatatgttttcctataccaatggggtttttctttcaaaaacaatttcagaacacatttttttcccaatcattaatttttcttatttcatcagttaacatgattaagatgaaatgagatatgtgaaaagccatcaacaccactttgaggctttacaatacctgccaacccttgagctctgacattgaactaggcactgttgtgaactatatacaaataatattatttacttctcactgtccttcaaaacagatactattactcttgctattttcctgataaggaaactaaagctcagagtgagagagcgctgtgcccaaggtcacacagctagggagcagcagagctagaggtcacagctaggcctccacttaagattcaagcttttaactactctgttcatattaagaaattcaaggtgaatcctaaagaaaaagaaagtggattgtggtttcttgcaaatgttgaaatattaactgaatgttatgccaaaaggagaaaaaaaaagccattttccccctttgaaatggcactgtcaggaatgactgaggctactgtgtgtgtatgacatctgacatctggaccatgagccaccagcatgtcccatgattttgcatttgacttaatgatctggggtcttcccagtggtatgatttagtggggcgggggtcgttgtccttaatgttggtttctcatcattgagaggtaaaagctagagttcttgtgacctaagcaaagagtggctttgactggagattggatttacaagaagatccatctgtgcagcctccatgggaaggggtcgcatatttatctcccaagaatttgacacaagccatttgtcagccacagtcacacatgcttgctgtttccatgcttgctccttttagtcaaagcaataattcctggttttgagagcacaactgtggggtgccaggtgttgatattttagaaacaaacagcggtaagggacagctgtggtggtggatttcaattttttttttccgccaagctggcgatagtatactatgcagatgaaattaaagcgtttcagacactaagtctttgcatctccacaataatgtgcgatttgtgatgacctttctctgagggactccccccggaatttaccttcattctgaggccagagcttcaaaggactgtgctgccgcacttataccttgtgaatgccatgagcgatctttcagattttcctgtactttctgtattgttccagcctctccaccactatgcctgttctcatcattatcattcatcaatatgcccattttcatgtcaattcaaattcagtgtgacatttgctttcactttcctttgtgggtcaacgtccttctgagcctcacaagcgctggttatggcataatgattactgctctgggtaatactcatttgtgtgttctcatttattaagggagaaataatttaatgaggtttctatgaattctttttgtttctcaggtaaaagcagcgcagtgctaacaaaaatcactcctccagattctttaataggtagtgaaatcagaccctcaaataaagtaaaattttaatttgatacaggattagtgggacattactttgatttttttaaatagttcaggttagtggttatagaaaatgctgtgttcaccctagcacttaactcctttgagaatcttatgaaagctatatacctctgcccagaaaaaaatgcaaatgtgttcaaggtttcagatacacttccaggttttcgtggatccagtgaacactttaccacgtatattctaggcttttgctaagagaacttttctgtgatgaaatgttcatatccacactgttcagtatggcagccatggaatacatgtggctattgagcatttgaaatatggcagatgcaaatgaggcactgaatttttaacctaatttacatttaaagagccacatgtggctaggaggtactatattgggtgattagctctagacaagaggttcacagacatgagactaagacccctatacatatatatttattttttaaaagcagctttattaagatccaagtcacatatcatacaatttggccatttaaagtatgtaatttaatgatttttagtatatttacacttatgcaaaccatcaccacaattaatcttagaagatttctctcacccaaaaagaaaccctaaattccactaatggtggaatttcccattttccctcagtttctgctagatctaggtaaccatgaatctacttttttttctccaagatttgtcaattctgaacattctagataaatggaatcacgatttttttcttcgtgactggcttctttacatcattctttgaaatgttcttttggatgttgttaatccatgatgtcatatcaatgatactgatcatgatgtatcagtgaccgtgatgaacaatacttcattcctttatgttgttgaataatattttattgtatgaatatatcacattttgtttatccattcatgaattgataaccatttgggttgcttccactttttggctatgatgaataatgctgctatgaatatccatgggtatctgtatggatgcatgtttcaaattctcttgggtatatatctaggagtggaattgctggatcatgtggtaactcatctgtaacatgtttggcactgccaaactgtttttctaagtgcttgcactgttttatattccctccagcaatgcatggtagcttcaatttctctacatcctcacgaatgcttgctatatatacttattaatttaagcattctagcaggggacaaaatggtatcttattatggttttggcttgtattttcctaatggctaaggatgtggagcatctcttcatgtgattattgaccatttgtgtattttttttttggaaaatgtctgttaaaattctttgtcaattttttgattgggtaattggtctttttattgttgagttgtaagcattctttatatattctggataagtccctatcatacatatatgatatacatcaatttgtattttatgtacaaaagatttacaaatacattctttcattctctgggttgtctttttactttcttaatggtgtcctttaagatgtaaattttttaatttagtaaagtccagtttatctatttttttgggtcaattaggcttttgatgtcataggaaagaaaccatagcctgatcgaatgtcatgaagatttaccctatgttttctactaacagttatagatttagctcttatattttggcctatgatgtattgtgagttcatttttttttgtttatgccatgagaacgggatccaactctgttcttttgtaggtggataaccaatagttctagcatcctttctttttgaaaaagtttaattaaaaatttaagatccataaattaagaaatcaacactttagcatttccctttcaatgcagttacatgattgccttttccatttgttcaaatatttttttccttttcttagttgacatgtaataattgtacatgttaatgggatatagtgtgatatttccatacatgtatacaatgtgtaataatcaaatcagagtagttagcatatccattatctcaaacacttaacatttcttcatgtcatgaacatttaaaatcctcttttctaccattttgaaaatatacactagactgacagggatctggcaagacagccaaatagaaacagctccagtctgcagctcccagcaagaccaacacagaagatgggtgatttctgcatttccaactgaggtacatggttcatctcattggtactggttagtcagtgggtgcagcccacggagggtgagcagaagccaggtggggtgttggcttacctgagaagtgcagggggctggggaacactctcccctagccaagggaagccatgagggactgtgctgtgagggacggtgctatccggcccagatactacgcttttcccacagtttttgcaacccacagaccgggagattccttcgggtgcctacacaaccagggacttgggtttcaagcacaaaactgggcgactgtttgggcaaacactgagctagctgcaggagtttttttctgtaccccagtggtgcctgaacgccagagaaacagaaccgttcactcccctggaaagggagctgaagccagggagccaagtggtcttgctcagcgggtcccacccccatggagcccagcaagctaagatccattggcttgaaattttcactgccagcacagcagtctgaagtcaacctgggacgctggagcttggtggggggaggggtgtccgccattactgaggcttgagtaggtagttttcccctcacagtgtaaacaaagccactgggaaattcagactgggtggaacccaccgcagctcggcaaggccgttgtagccagactgcctctctagattcctcctcactgggcagggcatctctgaaagaaaggcagcagccccagtcaggggcttatagttaaaactcacatctccctgtgacagagcactttggggaaggggtggctgtgggcacagcttcagcagacttaaacattcctgcctgctagctctgaagagagcagcagatctcccaacacagcacttgagctctgctaagggacagtctgcctcctcaagtgggtccctgacacctgtgcctcctgactgggagacacctcccagcaggggttgacagacacctcatacagaagagctctggctggcatctggcaggtgcccctctgggaggaagtttccacagaaaggagcaggcagcaatctttgctgttttgcagccccgctggtgatatccatgcaaatagggtttggagtggacctctagaaaactccagcagatctgaagcagagggtccagactgttacaaggaaaactaagaaacagaaagcaataacattaacatcaacaaaaaggatgcccaagaaaaaccccatccaaacatcattagcatcaaagatcaaaagtagataaatccatgaaggtgaggaaaaaacagcgcaaaaatgctgaaaattccaaaaaccagaacacctgttctcctccaaaggatcacaactccttgccagcaagggaacaaaactggacggagaatgagtttgacaaattgacagaagtaggctgcagaaggtgggtaataacaaactcttccaaactaaaggagcatgttctaacccaatgcaaggaagctaagaaccttgaaaaaaggttacaagaactgctaagtagaataaccagtttagagaagaacataaatgacctgatgaagatgaaaaacacagcatgagaactttgtgaagcatacacaagtatcaacagctgaatcaatcaagtggaagaaaggatatcagacattgaagatcaacttagtgaaataaagcatgaagacaagattagagaaaaaagaatgaaaaggaatgaacaaagcctccaaaacatatgggattatgtgaaaagaccaaacctatgattgactggtgtacctgaaagtgacagggagaatggagccaagttggaaaacacacttcaggataccacccaagagaacttccccagcctagcaagacaggccaacattcaaattcaggaaatacagagaccaccacaaagacactccttgagaagagcaacccaaagacacataattgtcagattcaccaaggttaaaaggaaggaaaaaatgttaagggcagccagaaaggtcaggttacctacaaagggaagcccatcagactaacagtgatctttctgcagaagttctacaagccagaagagaatgcaggccaacattcaatattcctaaagaaaagaattttcaacccagaatttcatatccagccaaacgaagcttcataagcaaaggagaaataaaatcccttacagacaagcaaatgctgagagtttttgtcacctgccttacaagagctcctgaaggaagcactaaatatggaaaggaaaaactggtaccagccactgcaaaaacataccaaaagacaaagacaatgatgctacgaagaaactgcatcaactaatgtgcaaaataaccagctagcatcatgatgacagaatcaaattcacacataacaatattaaccttaaatgtaaatgggctaattaaaagacacagcatagcaaattggataaagagtcaagacctatcgatgtgctgtattcaggagacccatctcatgtgcaaagacacaaataggctcagaataaacggatataggaatatttaccaagcaaatgaagagtgaaaaaaaagcagggtttcaatcctagtctctgataaacagactttaaaccaacaaagatcaaaaaagacaaagaggccatgacataatggtaaagggatcaatgcaagaagaagaactaactatcctaaatatatatgcacccaatacaggagcacccagattcataaagcaagttcttacagacctacaaagagagttagactcccacacaataataatgggagactttaacacctcactgttaatatttgatcaacaagacagaaaattaccaaggatattcaggactcgaactcagctctggaccaagcaaacctaatagacatctacagaactctccaccccaaatcaacagaacatacattcttctgagcaacacatcacacttattctaaaattgaccacataattggaagtaaaacacttctcaccaaatgcaaaagaacggaagtcataacaatctctcagaccacagtgcaatcaaattacaactcaagattaagaaactcactcaaaactgcatgactacatggaaactgaaaaacctgctcctgaatgactactgggtaaataaccaaattaaggcagaaataaataagttctttgaatccagtgagaacaaagatacaacataccagaatctctggaacacagctaaagcagtgtgtagggggaaatttaaagcactcagtgaccacattagaaagcaggaaagatcgaaaatcaacaccctaacatcacaattaaaagaactagagaagcaaagcaaacaaattcgaaagctaacagaagacaagaaataactaagatcagagcagaactgaagcagatagagacacaaaaaacccttcaaaaaatgaataaatccaggagctggttttttgaagagatagactactagccagactaacaaagaagaaaagagagaacaatcaaatagacacaataaaaaatgataaaggggagatcaccactgatcccacagaaatacaaactaccatgagagaatactataaacacctctacacaaataaactagaaaatccagaagaaatggataaattcctggacacatatgccctcccaagactaaaccagcaagaagtcaaatccctgaatagaccaataacaagttatgaaattgaggcagtaattaatagcctaccaaacaaaaaaagcccaggaccagatggattcgcagccaaattctaccagaggtacaaagaggatctggtaccattccttctgaaactattccaaacaatagaaaaagatggactccaccctaactcattttatgaggccagcatcatcctgataccaaaacctggcagagacacaacaaaaaaagaaaatttcaggccaatatccccgatgaacatcaatgcaaaaatcctcaatataatattgggtaaaggaatccagcagcacatcaaaaagcttatgcaccaaaaatcaaattggcttcatccctgggatgcaaggctggttcaacatatacaaatcaataaacataatccatcacataaacagaaccaatgaccaaaagcacatgattatctcaatagatgcagaaaaggccttcaatgaatttcaacaccccttcatactaaaaactctcaataaactaggtactgatggagcatatctcaaaataataagagctatttatgataaacctatacctaatatcatatcaaatgggcaaaagctggaagcattccctttgaaaaccagcacaagacaaggatgccctctcttaccactcctattcaacacagtattggaatttctagccagggcagtcaggcaagagaaagaaataaagagtattcaaataggaagagaggaagtcaaattgtctctgtttgcagatgacatgattgtatatttagaaaaccccatcatctcaaccccaaaactccttaagctgataagcaacttcagcaaattctcaggataaaaaaatcaatgtgcaaaaaccacaagtattcctatacaccaataatagacaaacagccaaatcatgagttaactcccattcgcaattgttacaaagagaataaaatacctaggaatacaactgacaaggcacatgaaggacttcttccaggagaactacaaaccactgctcaagaatataagagaggacacaaacaaatggaaaaacattccatgttcatggataggaagaatcaatatcatgaaaatagccatactgcccaaagtaatatgtagattaaatgctattcccatcaagctaccattggctttcttcacagaattagaaaaaactactttaaatttcatacggaaccaaaaatgagcctgtatagccaagaaaatcctaagcaaaaagaacaaagctggaggcatcatgctgccttgttgcgggaagtcagggacccagaacggaggaaccagctggagctgcggcagaggaatataaattgtgaagatttcattttaatatggacatatatcagctcccaaaagtaatacttttataatttcttaagcctgtctttactgcaatctctgaaaataaattgtgaagatttcgtggacatttatcagttcccaaaattaatacttttacaatttcttatgcctgtctttaatctcttaatcctgttattttcatcagctgagaatgtacatcacctcaggacctctattgtgttaaactgtacaaattgattgtaaaacatgtatgtttgaacaatatgaaatcagtgcaccttgaaaaagaacagaaaaacagtcattttcagggaacaagggaagacaaccataaggtctgactgcctgcagggtcgggcagaatacagtcatatttttcttcttgcaaagagcctataaacggacgtgcaagtagggaagaaatcactgaattcttttgctagaaggaatattaataattaagaccctgtgaaaggaatgcattcctggggggaggtctataaacagctgctctgggagtgtctatcttatgcattgagataaggactgaaatacgccctggtacgctgcagtacccttaggcttattagggtggggaaaaaaaccccaccctggtaaatttgaggtcggaccagttctctgctcttgaaccctgttttctgttgtttaagatgtttatcaagataatacatgcacagctgaacgtagacccttatggggagtttttgattttgccatttgccttgtggtctttgctttgccctttgccttgtgatctttactggcctcagaaacatgtgatctttgctctcctttttgccctttgatgcatgtgatctttgtgacctactccctgttcgtacaccccctccccttttaaagcccttaataaaaaccttctggtttttcagctcaagtgggcctcaaggtcctacctatatgtgatgtcaccccggaggcccagctgtaaaattcctctctttgtactctttctccctatttctcagctggccgacacttaaggaaaatagaaagaacctatgttgaaatattgggggctggttcccctgatactacctgacttcaaactatactacaaggctacagaaaccaaaacagcatggtactggtaccaaaacaaatatatagaccaatggaacagaatagaggcctcagaaataataccacacagccagaaccatctaatctttgacaaacctgataaaaacaagaaatggggaaaggattctctatctgataaatgatgttgggaaaactggctagccatatgtagaaaaccgaaactgtaccacttccttacaccttatacaaaaattaactcaagatggattaaagacttaaacgtaagacctaaaaccctagaagaaaacctaagcaataccattcaggacataggcatgggcaaagacttcatgactaaaacacaaaaagcaatggcaacaaaagtcaaaatcaacaaatgggatctaattaaactaaagagcttgtgcacagcaaaagaaactatcatcagagtgaacaagcaacctataaaatgggagaaaattttgcaatctattcatctgacaaagggctaatatccagaatctacaaggaatttaaacaaatttacaagaaaaaaacaaaagccctgtcaaaaaatgggcaaaggatatgaaaagacacttctccagagaagacatttatgtggccaacaaacacataaaaaaagctcatcatcactggtcattagagaaatgcaaaccaaaactacaatgagataccatctcctaccagttagaatggcaatcatcaaaaagtcaggaaacaacagatgctggaaaggatgtgaagaaataggaatgctttcacactgttggtgggagtgtaaattagtttatccattgtggaagacagtgtggagattcctcaaaaatctagaaccggaaataccatttgaccaagcaatcccattactgggtatatacccaaaggattatacatcattctactataaagacacatgcacacgtatgtgtatcgcagtactattcacaatagcaaacagttggaactaagtcaaatgcccatcaatgatagagtggataaagaaaatgtggcacaaatacaccatgggataccatacaggcataaaaagaatgagttcatgtcctttgcagggatacggatgaagctggaaaccatgattctcagcaaagtaacacaggaacagaaaatcaaacattgcgtgttctcacttataagttggagctgaacaatgagaacacatggacatggggagggaaacatcacacaccggggcgtttcagggggtagggggcaagaggagggatagcattaggagaaattcctaatgtatgaagggcttaaaacctagatgatgggttgatgggtgtagaaatcaccatggcacatgtatagctatgtaacaaacctgaacatcctgcacatgtatcccagaacttaaagtataataaaaaaagaataaaaaaataaaaaacacaaatgaacaaacaaaaaaagaaaatgtaaactaaattgtcattaaccatattcacctaacagtgctacagaacactagaacttattccttctctctagctatcattttatatccattaaccaacctctccctagcctcctccctctctaaaccttcttagcctctaataaccactattctactctctacttctacaagctcaatttaactctttcttgaaaagaccactctttgctcattgaattgtcttgattcctttgtcaaaaatcaattaaccataaatgtaaaggtttatttctgaactctcaattctattctattgatctatgtctatcctcaggcaagtatcacactgtcttgattactatagctttgtagtaagttttgaagttgaaaaatgtaagttctgtaatttttgttcttctttttcaagattgttttgaagctcttctgggtctccttcattcctatatgaatatttggataagtttgccaatttctgtaaaaaaaaaaaaaaccatctggggttttgatcaagattttgttgagtccaagatcaatttgggaagtattgccattttaacaatagtaagcctactgatctaggtacatgcattgctttgttgaatatattcattggaaattcttttacagcaattctgtcccacagcttattttctttcattcacttcaaattatttcatatccatctactgattattttaaaactaatattttgagaaaaatcatatgtattttcatgacacaaccacttatatatttttcatttttattgagtgtctactatgttctctgcatgttgttaagcattcctgattttagtaatgagtcttctcattcttctggtcagtatagctaaaggtttgttgattttgttgatcttttaaaagaaccaacttttagtttcatatattttttttgtatttcctattctctagttcattaatttctgctctaatctttattatttccttccttctgcctactctaggtttagttggctcttttttccccagtgtcttaaggtggaaagtaaggctattgacttgagatctttcttctcttttcatgtaggcatttatagctataaattttcctctaatagctgctttagctgcatcccatcagtttatagactgtgtttcgttttcatccatctcaaattattttctaatttccttgtaatttcttctttgatccactggttatttaggcatataagttcatttaagtgttaagttcaataatttaattatggaagggaaaaattccaatttctcttgcaaatcaaaaccacaatgtaatactatctcacaccagtcagaacagctattactggaaagtcaaaaaataacagacgctggcaaggttgctatatggtttggctgtggccccacccaaatttcatcttgaattgtaactcccacaattcccacatgttgtgggagaaactcagtgggagggaattaaattatgggggtgggtccttcctgtgctgttcttgtgatagtgaatgagtctcacgagatctgatggttttaaatacgggagtttctcttcacaagctctctctttgcctgccactattcacataagatgtaacatgctcctccttgccttccaccatgattgtgaggcttccccagccacatgcaactgtgagttctccattaaacttctttcctttgtaaatctccctgtcttgagtatgcctttattagcagggggaaaatggactaatacagttgtggaggaaagagaacacttaaacactgttatggggagtataaattagctcaaccattgtggaaagcagtgtggtgattcctcaaacagctagaaacagaaatacaacttaaagtagccatcccattactgggtatatatccaaaggaatataaatcatcctatcataaagacagatgtacatgtaagttcattgtagcactatacacaatagcaaagacgtggaatcaacctacatgcccattaatgactgatcgaataaagaaaatgtggtaaatatggccaggtgtggtggctcacacctgtaatcccagcactttgggaggcctaggtgggtacatcacctgaggtcaggagtttgagatcagcctggccaacatggtgaaaccctgtttcaactaaaaatacaaaaattagctgggcatggtggcacacacctgtaatcaaagctacttgggaggctgaggcaggataatcacttgaacttgagacgtggagattgcagtgagccaagattgtgccactgcactccagcctgggtgacagagtgagactctgccaaaaaaaaaaaaatatggtaaatatacaccatggaatattatgcagccacacaaagaatgagaccatgttctttgtaggaacatggatggagcaagaggccattattcttagcaaactaacacaggaacaaaaaaccaaatactgcatgttctcacttataagtgggagctaaatggtgagaacctatggacagcaagagggtacaacagacactagggcctacctgaggtaagagggtgagagaagggagaggattagaagaaaaaactattgggtaccaggcttagtatctgggtgttgaaataatttgtacaacaaactctcgtgacacaagtttacctacataacaaacctgcacatgtacccctgaacctaaaataaactttttttaaaaagaaaaacatcaatttgtcacctgctaggttctgatttttttaaatgagtcatttgcattcagcaaataaacatactttctgtacttatttagttcatttccacttctacatctttgtacctgcttctccagctttaatatgcacacaggtcatctgggaattttgctaaaatgcagattctgtcggtctggtgcaggccctgagatttcacatttaatacaaattcccaagtgctgctgattctgatgttgctagtttggtgaatcggttttgagtaggaagcctttatgcaactacttggaatgtccttctcaattattctttgtgattaggctcaaaatggtcctttgcccaaaagctcctatactttgtccctctagtcagaggtgaatatatccttttctagaacctctaacatccttctcataccctttatttgtacttgccccattcttttaatcatttctttatatagtgttttctgccaaaggactatgaaactaaggagagcagggttttgttctcttcatgactttgtgcttcagtgtctgagggttcagactagatgtttattaactatccagtgaatggattataatagctaacactttttttttctacaaaagaaagagatttattggacttacagttccacacggctggggagacctcacaatcatggcagaaggcaaggagaagcaagtcacatcttacatggatggcagcaggcaaagagaggtcttgtgcagagaaactcccatttttaaaaccatcagatctcatgacacccattcatataaaggctaacatgttttgtgtgtcaactacgtgccaggacagcgtcaagtgctctgcagatgtcatctcatttaatcatcacaccagccccatgaggaaggtttcattattatcctcattttgcatacaggcgctgaaaatcttatttgtgttcatgattagctgaatttgtttctggttcttttagaaaattaacagtctaatttaactacacagaacaaagctctgggggaatctaatacatgctgcattttatttgcatgtattatgatagccaaatcaaaaacagagaaacagcaaaatactgtttccttttatgcctacatggggtactgaaacaggtggacagcaacaatgatgctgcttctctagtcctgccctcacctgtggtcagtgtattcctatgtggtcagtgcatttgtctccagctcggtctcctgccttcagcttcctctcttctatgcatcctctaaaatatgaattagatcatgccactgcctacaatattctctgacttataggttccctataagataatgtctaaactccctagggcagtttaaaattttcctttcggcaaactgtctagcatctcctccttctatctcctttacacacactatacttcctaagtctagaatgactagtcattccccaggcatggcaagcttttacttctttgagtcttgcacgtttttcttcccactgccttcagtatccttcctccctgaactgacctgtcccttgccaactcatcctttagtacccagctcctaccagctccactgaaaaaatggtctcagctccaccctgtgctccaggcttttccctctgtgctttcttagaattatacacataactctgatatcatatgaatagttgccacattttatcatactaaaatatatatctattcatatattttcatcaaaggctgtgagctcctccagggctagaaatgccttatccttttactaaacacaaaaattaggactcaatgggtattgttgagtaaaaaatttggttaaaatataagtagattgggactaagacaccaactttatctacaactagagctctttcccattcattaccaaagctcttcaagtgtctaatttctatagcaagtatcacatctgctttgaattagagttatgtttgtgcatgaaattctgagttcctctaaagggctggagttacagcacattcatctttgtatctctcggctcacatagggagtgtcttgcacatagaaaccattccatgaaggtctgcagaactgaaataagcttaactagattcacaggttttagccaagttattataaagcctcccactactctggggaaacaattatcttcaacccaggagtgagggatctattgcaatgctgtttgatgtttcacactctcacattcccatggcaagagacatctttgaaacacatgggtgtactgtctactctgattacatcagtcaacacccgaaccagataacagctatgcaatgaatgtgaaaagagaaggagtcattttagaatgcagaagtcaattgcagaagtagaaatgactcagacagcaatgcacttgaatttgaaacagtgttcatagctccactctttttatattttgttgtatcacaaatgaatttgtagatgaacatagtagcatggctctcttgatgatttcttcacattgcagcctcaaactcactctttttctcactattctgcaagcatttattgagcatcaactaagcatgaagcactatgctaggtaccactacaataaaagatttggtaggggaaatatagaatcaaaaaactttactgggtacttaaaaataatattttcaattgcaaatgcaagaaaaatcatatgcagtcagtataacacctgtaattgctttagtccatatatggttttaaattcaaatttgctgttggatactgcaaaatcaatagcttaatgattctaatggttatatattagcaacatttgcagctctaagacagtgataattgatattaatgtaactgttcctaggatgaagacaaatattaatatggccactgctttcttcaccaattcatctccttccacgcttctgattttttccacatacctcagccacaatggcttttctttttttttttaattattatactttaagttctgggatacatgtgcagaatgtgcagctttattatataggtatacacgtgccatggcgaatggtggtttgctgcacccatcaacatgtcctctacattaggtatttctcctagccacactggcctttctccagagtcttggagactttcagctcctatgacaaagcttgcacatgctgttccctctgcctgggacatcttatctccccttccccattcacataagtaaccctatttatccttcatgtcccagggcagtgtcactttctcagaaaaggtttccctgaccaggtcatatcctcctctcatacatcatcccagcaccaaagacctttccttcagagcatttacagtagttacaattttgtagttgctttaaaaaatcttgtccttattgcttttctggtacctctactggactgtaagttcatgaagatagcgaggcaatttatttttgtttactactggctcagcagagtgaaggaaacacaggaggtactcaattttaaaacactactgaataaattaatcttagctcactgcaacctccgcctcctgggttcaagagattctcgtgcctcagtcctcccaggagctgggattacaggtacattccaccgtgcctagctaattttttgtattttcagtagagatgaagtttcaccaagttgcccaggctggtcccgaactcctgagctaaggaaatctgcccacttcagcctcccaaagtgttaggattacaggtgtgagccactgcacctggcctgatctgccatttcaatattagtagttggaaattattccatgtttgcagatggatataaaaacagttgaattgaatgaaagaaaaaagctgcagaacaggattgcaggaggagactctcaaatgaatatattcaaagatgtagagtcaaagtggattctgaaaacattaaaaattataaacaagataccctacattcaaagatactatggataaattataggaactttccccaaaagctgtgatggcaagaaaaatataacgctcagacttttgaaacgttaaaaaaaagaaagcagtggtataaggcaaccatcttctcatttatggcagaaatgtagactcctcctaaaatgaatctgaaagccacatgagcatgtaactactttagaggtcagtcagtcaaaattctaactgaatctaccctggagattacacctaccgatataaactatgaactaagtgcatcagttatgtatgcaagagtgaaatgagggtgtgggcatgtgtaaatgaaacattgtgattaatacacctgtcagaaattagaatgctatgccagttggtgatttgccttaagcttctctcccggagagctcatattgcaaaagatgccagttgttctacttgacaccaccatttgtttttggtggaccacgtagaattgggtcttagactcagctctgcattgaaataagtaagaaaattcttccttttttaggctcaaaggggcctgtgggccagcatatgatgtgtattgtcaggtggaatacttagatctacgacaaaattctcctttatgaaagcttgttgagaactcttggctaggggtgggtgttttccaaatgtgacttcggaagtctgcagggacttggcacaaaggaacctggttccctcagcaattacagaacttttataaagagtaggcctcagaaaataagcttgtactctgatgatttcaatgctcagacaggaagccgtatagggtattgccatgaagtgaagtctccatgcccatgggaacagaatcttgccctgaaatgacagtccgatctgttttccttgctcaaccttatcctctatcctttcctaattcctggtataatgtgccttccttgctctataagtgatgggctcctctgcaacatgattcttataaagagcttttgattaattaaagaagagacagagaggcttgggtaatcagtcatgcaattcacctgttcataaccaatttcatgcctgctctcacccactcaatggcacatggtcaacttctcaaaggtctggggtgaattttcacagatggggtctgcagaaaatcctctgcatattatgttagtggtaatgtagttactcaactatgtaatacttagtggaatgcgtttcatcctaaaggataaaatagaaaaactcctttggaataaaatttggcaatattaatcaagcatcaggaaatgatcaaaaacgttcacacagcattaacattttgctctttaaaatctctaaggaaataactgataaaaactatgtgcacaaagatacttatgattgcgttttttattatagcaaagaaatggaaagaaatcaagtaacaaatagaggaacagttaaataaaatgtggtacatccccttgtggaaataaagtgattattgttgaagatagttagcaagactaggaagcagactgaaaaaaaatgcttaggactaacgtgaaataaaaaaaatcagaacacaaagttaaatttatatgatgataataaataataaaatatacacaccataaaatacaagaaggaagtatattaaattgttcccggggtggggggtttaaattgtgggattgttgtctgtttttatcctcacctttaacacagtctagtgagtatgattttttttttaaaaaaagaggtttatagagatataattcacataccaaaaggttcactcttttcaaatgtacagcccagtggtttttagcatattcaaagagctgtgcaaacatcaccactctctaatcccaggatgttttcatcatccctcaaagaaacttggtaccctttagttgtcactccctgtttggtcctcgccctagcccatggcaaccactagtttattttcagtctgtacaga
